US010738299B2

(12) United States Patent
Steelman et al.

(10) Patent No.: US 10,738,299 B2
(45) Date of Patent: Aug. 11, 2020

(54) COMPOSITIONS AND METHODS FOR LABELING OF AGENTS

(71) Applicant: THE BROAD INSTITUTE, INC., Cambridge, MA (US)

(72) Inventors: Scott Steelman, Wilmington, MA (US); Robert Nicol, Cambridge, MA (US); Robert E. Lintner, Amesbury, MA (US)

(73) Assignee: The Broad Institute, Inc., Cambridge, MA (US)

( * ) Notice: Subject to any disclaimer, the term of this patent is extended or adjusted under 35 U.S.C. 154(b) by 173 days.

(21) Appl. No.: 14/664,356

(22) Filed: Mar. 20, 2015

(65) Prior Publication Data

US 2015/0267191 A1 Sep. 24, 2015

Related U.S. Application Data

(63) Continuation-in-part of application No. PCT/US2013/061189, filed on Sep. 23, 2013.

(60) Provisional application No. 61/703,884, filed on Sep. 21, 2012, provisional application No. 61/731,021, filed on Nov. 29, 2012, provisional application No. 61/779,999, filed on Mar. 13, 2013.

(51) Int. Cl.
*C12Q 1/6869* (2018.01)
*C12Q 1/6855* (2018.01)
*C12N 15/10* (2006.01)

(52) U.S. Cl.
CPC ....... *C12N 15/1065* (2013.01); *C12Q 1/6855* (2013.01); *C12Q 1/6869* (2013.01)

(58) Field of Classification Search
CPC ................ C12Q 1/6855; C12Q 1/6869; C12Q 2521/313; C12Q 2525/191; C12Q 2563/159; C12Q 2563/179; C12N 15/1065

See application file for complete search history.

(56) References Cited

U.S. PATENT DOCUMENTS

| 2002/0142313 | A1 | 10/2002 | Wolber et al. |
| 2004/0005609 | A1 | 1/2004 | Wolber et al. |
| 2004/0110191 | A1* | 6/2004 | Winkler ............... C12Q 1/6809 435/6.14 |
| 2012/0010091 | A1* | 1/2012 | Linnarson ......... C12N 15/1096 506/7 |
| 2012/0122714 | A1 | 5/2012 | Samuels et al. |
| 2013/0225418 | A1* | 8/2013 | Watson .................... G01N 1/30 506/2 |

FOREIGN PATENT DOCUMENTS

| EP | 1024201 | 8/2000 |
| WO | WO2004094664 | 11/2004 |
| WO | WO2006040549 | 4/2006 |
| WO | WO2006086210 | 8/2006 |
| WO | WO2008007951 | 1/2008 |
| WO | WO2012037882 | 3/2012 |
| WO | WO-2012048341 A1 * | 4/2012 ........... C12Q 1/6869 |
| WO | WO-2012083225 A2 * | 6/2012 ........... C12Q 1/6846 |
| WO | WO2013134261 | 9/2013 |

OTHER PUBLICATIONS

International Search Report for International application No. PCT/US2013/061189.
Meyer Matthias et al: "Targeted high-throughput sequencing of tagged nucleic acid samples", Nucleic Acids Research, Oxford University Press, GB, vol. 35, No. 15, Jan. 1, 2007 (Jan. 1, 2007), pp. e97.1-e97.6.
Rong Lu et al: "Tracking single hematopoietic stem cells in vivo using high-throughput sequencing in conjunction with viral genetic barcoding", Nature Biotechnology, vol. 29, No. 10, Oct. 2, 2011 (Oct. 2, 2011), pp. 928-933.
International Preliminary Report on Patentability and Written Opinion dated Sep. 24, 2015, which issued during prosecution of International Application No. PCT/US2013/061000.
Extended European Search Report issued by the European Patent Office in corresponding Application No. EP 13838452.4 dated Jun. 16, 2016.
International Preliminary Report on Patentability for International Application No. PCT/US13/060990 dated Sep. 24, 2015.
International Search Report and Written Opinion for International Application No. PCT/US13/060990 dated Jan. 23, 2014.
International Search Report and Written Opinion for International Application No. PCT/US13/061000 dated Feb. 4, 2014.
International Search Report and Written Opinion for International Application No. PCT/US13/061182 dated Jan. 23, 2014.
Sibson et al., "Molecular indexing of human genomic DNA," Nucleic Acids Res, 29(19):E95 (2001).
Zhu et al., "Single-Molecule Emulsion PCR in Microfluidic Droplets," Anal Bioanal Chem, 403:2127-2143 (2012).

* cited by examiner

*Primary Examiner* — Teresa E Strzelecka
(74) *Attorney, Agent, or Firm* — Foley Hoag LLP

(57) ABSTRACT

The invention provides, inter alia, methods for uniquely labeling populations of agents of interest using random combinations of oligonucleotides. The oligonucleotides may comprise a unique nucleotide sequence and/or one or more non-nucleic acid detectable moieties.

6 Claims, 62 Drawing Sheets

Specification includes a Sequence Listing.

The biotinyalted adapter can only ligate in one orientation on each end of the genomic DNA due to the presence of the T-tail. The adapter is a partial duplex to allow for primer annealing in the next step of the process.

Multiple index libraries are created in emulsion droplets or in well plates and a polymerase-driven fill-in reaction is used to add the index. The index libraries may contain some or all of the key components of the fill in reaction (i.e., $MgCl_2$, dNTP, Polymerase). The library is comprised of unique single stranded DNA oligonucleotides (oligos). Each oligo will contain 3 distinct moieties: sequence complimentary to adapter (Ad), a unique index sequence (Idx), a sequence used to "capture" the next index oligo which contains one or more dUTP nucleotides (B'/C').

DNA is diluted to a desired concentration to control the number of molecules per droplet or well and is merged with (in droplets) or added to (in well plates) the index array.

A fill-in reaction is performed creating the complement to the index and the "captur" site.

DNA is then pooled and treated with USER enzyme causing the "capture" portion of the indexed oligo to be digested/released from the nascent strand which does NOT contain dUTP. If emulsions are used, droplets must be broken prior to DNA pooling.

The process of DNA dilution, index addition, fill-in, pool, and USER enzyme treatment is repeated for the desired number of cycles, each time adding one new index to the end of the DNA.

After the final index addition, DNA is fragmented and the ends are collected via streptavidin beads.

All fragments are ligated to technology specific sequencing adapters and ends are informatically paired based on their unique string of indexes.

FIGURE 1C

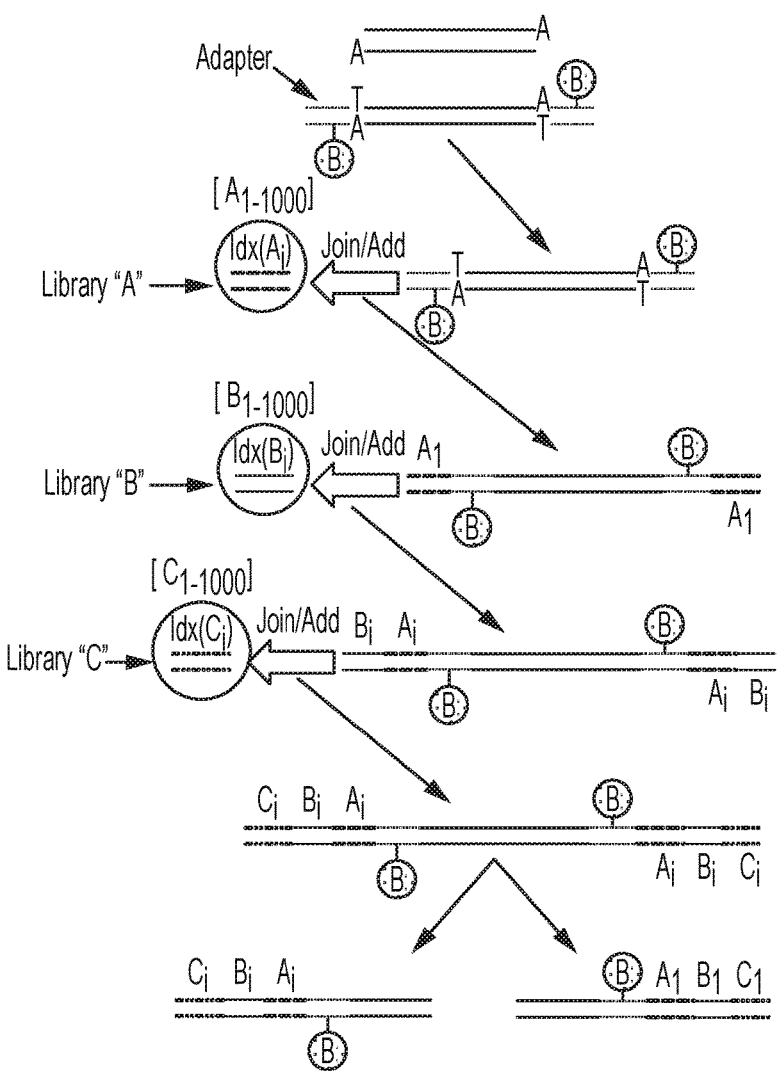

The adapter can only ligate in one orientation on each end of the genomic DNA due to the presence of the T-tail. This makes it possible to design custom sequencing primers to the adapter.

One or more index libraries are created such that each library (array) will contain an estimated 1000 elements (indexes). For this approach a single library of 1000 elements can be used repeatedly, or multiple discrete 1000 element arrays can be created. For a given array, each droplet will contain many copies of one and only one index sequence. Droplets/wells may contain some or all of the key components of the ligation reaction (i.e., $MgCL_2$ ATP, Ligase)

DNA is diluted to a desired concentration to control the number of molecules per droplet/well and is joined with/added to the index array allowing the ligation reaction to occur.

Following ligation, DNA is pooled, purified and phosphorylated so that it can accept the next index. If reactions are performed in emulsion, droplets must be broken prior to DNA pooling.

The process of DNA dilution, index addition, ligation, pooling, clean-up and phosphorylation is repeated for the desired number of cycles, each time adding one new index to the end of the DNA.

After the final index addition. DNA is fragmented and the ends are collected via streptavidin beads.

All fragments are ligated to technology specific sequencing adapters and ends are informatically paired based on their unique string of indexes.

FIGURE 3A-2

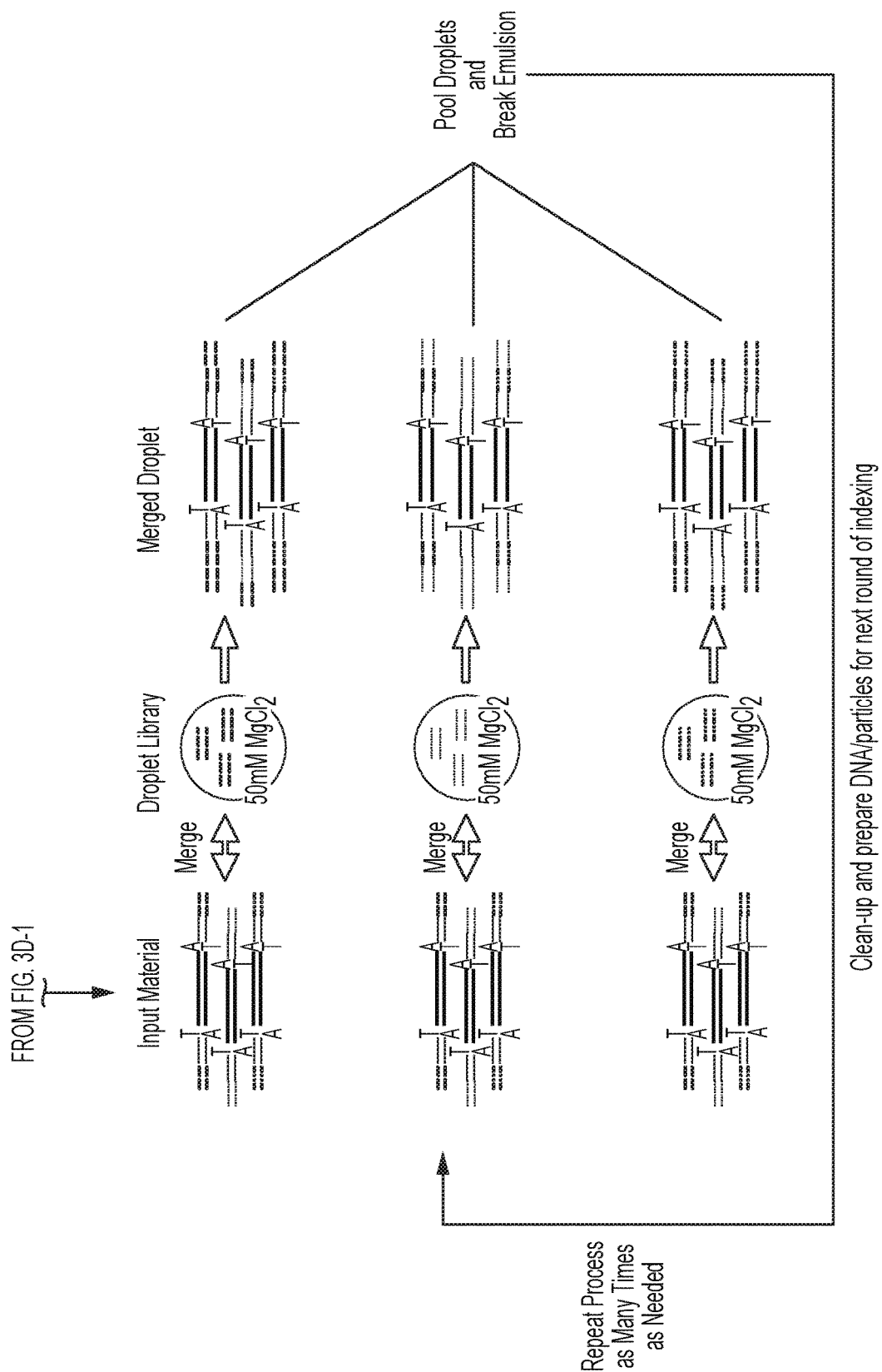

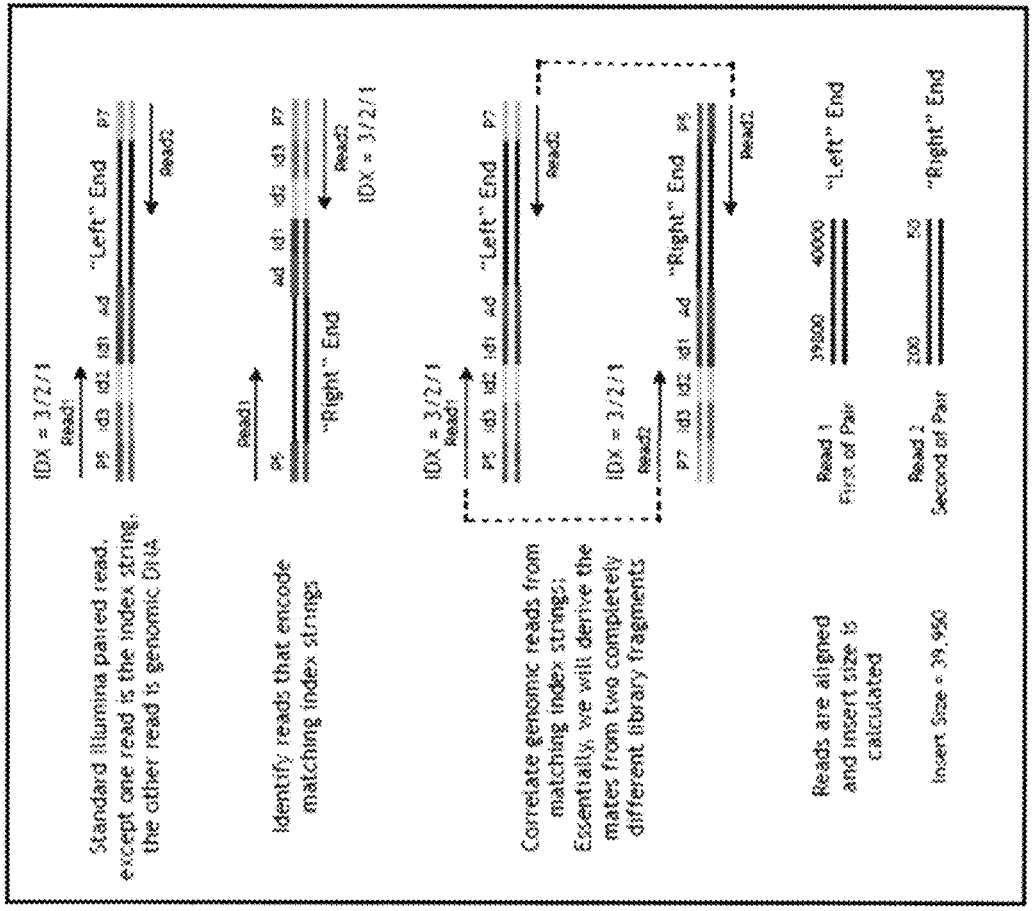
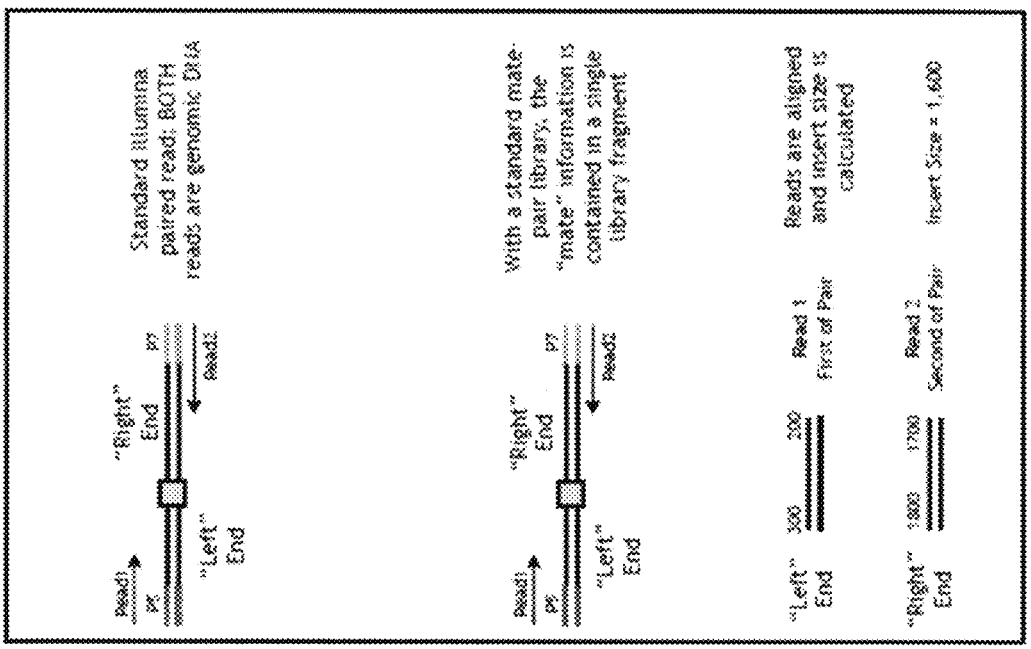
Figure 3E

Solid support particles (e.g., paramagnetic beads) are purchased
and conjugated to a cleavable linker (photo- or chemically cleavable).
Each particle will have a vast number of binding sites on it's surface
(a single binding site is shown for illustration). Although shown as
dsDNA, the linker can be any substrate that supports the covalent
addition of a dsDNA.

Arrays of dsDNA indexes will be prepared in 384-well (or 1536-well)
plates. We estimate we will use 2 to 4 index arrays, each containing
~1000 unique elements for a total of ~2000-4000 unique indexes.

Particles will be aliquotted into 384-well (or 1536-well) plates at a
density to be determined.

Using a liquid handling robot, ligase buffer and ligase enzyme will
be added to the particle plates. An aliquot of index array "A" is then
added to the plates.

Following ligation, particles will be pooled using a liquid handling
robot, collected (e.g., using a standard magnet for paramagnetic beads)
and washed to remove unwanted material.

A kinase reaction will then be performed in order to permit the addition
of the next index.

Particles will then be resuspended and aliquotted into 384-well (or
1536-well) plates at a density to be determined. This "shuffle" will
randomly redistribute the particles, minimizing the possibility that multiple
particles will contain the same series of indexes.

We will perform an estimated 2-4 rounds of index ligation in the
manner described above.

Using this strategy, we can create a population of particles such that
each will have a vast number of copies of the exact same index sequence
on it's surface, effectively giving each particle a unique molecular label,
BUT no two particles are likely to carry the same series of indexes.

The indexed particles can then be further modified as described above
to present a "capture" oligo (e.g., oligo-dT or a sequence specific
capture probe) or simply be used "as is" for ligation to a population of
dsDNA molecules.

After 3 successive rounds of index ligation, the population of particles
will be able to accommodate >$10^9$ unique molecules.

This technique is ideally suited to be performed in common plasticware,
but can also be performed in emulsion droplets.

- Ultimately, need PCR-based assay to detect ligation
  - Designed small (34bp) adapter
  - Biotinylated and A-tailed (to force directionality)
  - Can use primers to adapter for sequencing (still needs to be confirmed)
  - For these experiments, use lambda DNA as template since it is unlikely to form circles/concatamers

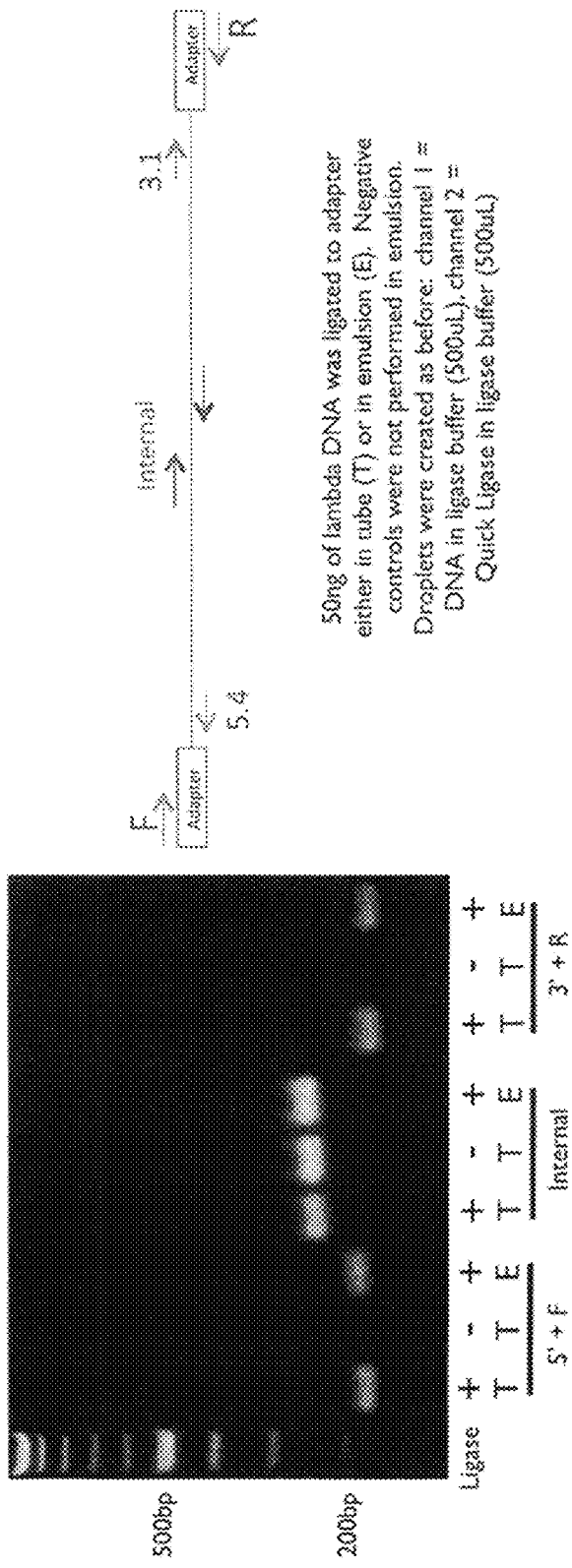

50ng of lambda DNA was ligated to adapter either in tube (T) or in emulsion (E). Negative controls were not performed in emulsion. Droplets were created as before: channel 1 = DNA in ligase buffer (500uL), channel 2 = Quick Ligase in ligase buffer (500uL)

Figure 18
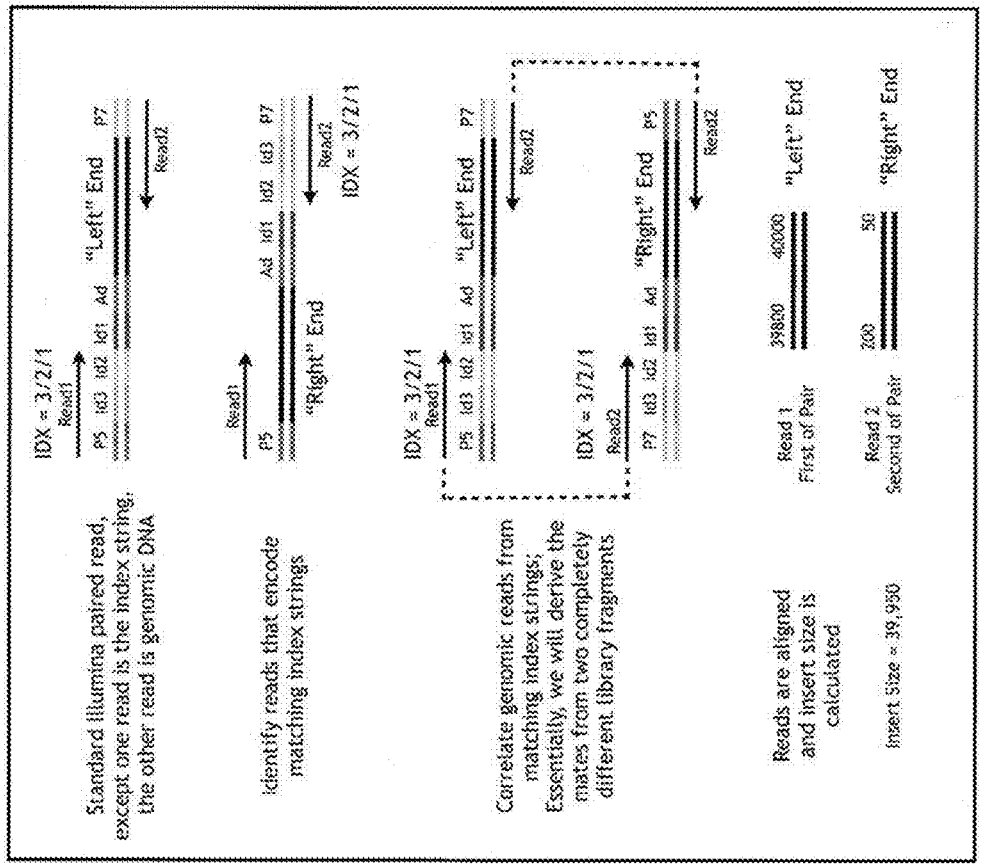
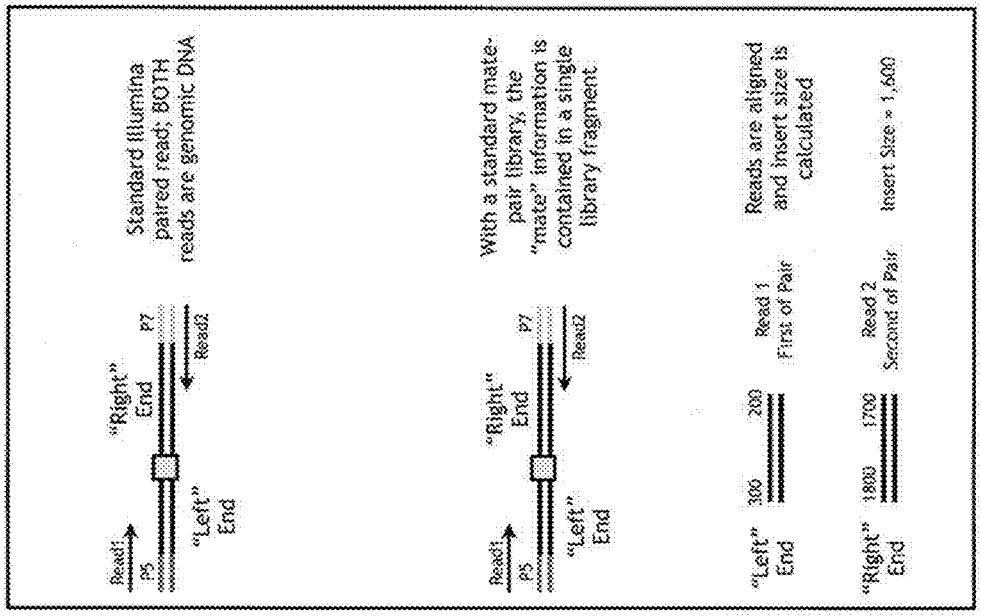

Figure 21

Determine Optimal Molar Ratio of Index:gDNA

| Molar Ratio Index:gDNA | % of Indexed Reads |
|---|---|
| 25:1 | 46% |
| 50:1 | 47% |
| 75:1 | 47% |
| 100:1 | 56% |
| 1000:1 | 58% |

Figure 28

Impact of Ligation Efficiency on Bioinformatic End Association

| | "Left" End of Parent Molecule | "Right" End of Parent Molecule | Information Space Using 384 Index Array: | Information Space Using 1152 Index Array: |
|---|---|---|---|---|
| Case 1: Perfect Symmetry | id3 id2 id1 | id1 id2 id3 | ~5.7 × 10$^7$ | ~1.5 × 10$^9$ |
| Case 2: Imperfect Symmetry | id3 id2 id1 | id2 id3 or id1 id3 or id1 id2 | ~1.5 × 10$^6$ | ~1.3 × 10$^6$ |

Figure 36

Transposome-based Selection and Amplification of Ends

Ligate P7-SP1 adapter to ends of construct

P7-SP1-Idx-Cap ———————— Cap-Idx-SP1-P7

Treat with P5-SP2 transposome (might only want to use SP2 and put P5 on later via PCR)

P7-SP1-Idx-Cap ———— Tnp-Sp2-P5   +   Tnp-SP2-P5 ———— Tnp-SP2-P5

PCR amplify using P5/P7 primers

P7-SP1-Idx-Cap ———— Tnp-SP2-P5

Figure 39

Creating Multi-Kilobase Fragment Reads from Indexed DNA Ends

COMPOSITIONS AND METHODS FOR LABELING OF AGENTS

RELATED APPLICATIONS AND INCORPORATION BY REFERENCE

This application is a continuation-in-part application of international patent application Serial No. PCT/US2013/061189 filed Sep. 23, 2013, which published as PCT Publication No. WO 2014/047561 on Mar. 27, 2014, which claims the benefit of and priority to U.S. Provisional Application Ser. No. 61/779,999, filed Mar. 13, 2013; 61/731,021, filed Nov. 29, 2012; and 61/703,884, filed Sep. 21, 2012. This application is related to U.S. Provisional Application Serial No. 61/779,999, filed March 13, 2013.

The foregoing application, and all documents cited therein ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE LISTING

The instant application contains a Sequence Listing which has been submitted electronically in ASCII format and is hereby incorporated by reference in its entirety. Said ASCII copy, created on Apr. 29, 2015, is named 46783.01.2017_SL.txt and is 608,167 bytes in size.

FIELD OF THE INVENTION

The invention is directed to methods for labeling populations of agents of interest using random combinations of oligonucleotides. All documents cited to or relied upon below are expressly incorporated by reference herein.

BACKGROUND OF INVENTION

The ability to label and distinguish agents of interest (e.g., DNA, proteins, chemicals, cells, etc.) serves multiple purposes in research and industry. However, several limitations exist in current labeling technologies. These limitations include the limited number of distinguishable detectable moieties currently in existence, the amount of time required to uniquely label a plurality of agents, the requirement, in some instances, for specialized equipment, and the cost involved.

SUMMARY OF INVENTION

The invention provides, in part, methods for uniquely labeling agents in a dynamic manner. The methods allow a plurality of agents, ranging from 2 to millions of agents, to be uniquely labeled without the need to manually generate the same number of unique labels. The agents may be of diverse nature, In some important embodiments, the agents are nucleic acids such as genomic DNA fragments. The invention contemplates that agents may be labeled in order to identify them, identify their source, identify their relationship to other agents, and/or identify one or more conditions to which the agents have been subject.

The methods of the invention also provide for amplifying nucleic acids to increase the number of read pairs properly mated via their unique index combination. In a further embodiment, the method of the invention allows for each end-labeled nucleic acid to be identically labeled at its 5' and 3' ends.

The unique labels provided herein are at least partly nucleic acid in nature. The invention contemplates that the labels are prepared by sequentially attaching randomly selected oligonucleotides (referred to interchangeably as oligonucleotide tags) to each other. The order in which the oligonucleotides attach to each other is random and in this way the resultant label is unique from other labels so generated. The invention is based, in part, on the appreciation by the inventors that a limited number of oligonucleotides can be used to generate a much larger number of unique labels. The invention therefore allows a large number of labels to be generated (and thus a large number of agents to be uniquely labeled) using a relatively small number of oligonucleotides.

BRIEF DESCRIPTION OF DRAWINGS

Non-limiting embodiments of the present invention will be described by way of example with reference to the accompanying Figures, which are schematic and are not intended to be drawn to scale. For purposes of clarity, not every component is labeled in every figure, nor is every component of each embodiment of the invention shown where illustration is not necessary to allow those of ordinary skill in the art to understand the invention.

FIG. 1A-1C is a schematic of a mate pair synthesis using droplets or multi-well plates and oligonucleotides tags which may comprise unique sequences (such unique sequences referred to as "index sequences" or "Idx"). The oligonucleotides are attached to each other, to form a unique label, using polymerase fill-in reactions. It is to be understood that a droplet or well may typically comprise an oligonucleotide tag of a single type, although it may contain (and most likely does contain) multiple copies of the same oligonucleotide tag.

FIG. 3A1-3A2 is a schematic of a mate pair synthesis using droplets or multi-well plates and oligonucleotides tags which may comprise unique sequences (such unique sequences referred to as "index sequences" or "Idx"). The oligonucleotide tags are attached to each other, to form a unique label by virtue of the index sequences, using ligation.

FIG. 3D1-3D2 is a schematic illustrating index addition to either beads or DNA using droplets.

FIG. 3E is a schematic illustrating an approach to informatically associate mate pairs in accordance with the invention.

FIG. 6A-6C is a schematic of a plate-based approach to the generation of unique index combinations (labels). The unique labels are generated on particles or directly on nucleic acids (e.g., genomic DNA and cDNA). Oligonucleotide tags are present in the wells of multiwell plates. It is to be understood that a well may typically comprise an oligonucleotide tag of a single type, although it does contain multiple copies of the same oligonucleotide tag. Each well may comprise, at any given time, one or more beads or nucleic acid fragments.

FIG. 11 discloses the 'Adapters' as SEQ ID NOS 2324-2327, respectively, in order of appearance, the 'emPCR particles' as SEQ ID NOS 2328-2329, respectively, in order of appearance and the 'Primers' as SEQ ID NOS 2330, 2331, 2329, 2328, 2332 and 2333, respectively, in order of appearance. FIG. 11 discloses the 'emPCR Solution Phase Products' as SEQ ID NOS 2324, 2325, 2334 and 2335, respectively, in order of appearance. FIG. 11 discloses the 'emPCR bead-bound Products' as SEQ ID NOS 2336-2339, respectively, in order of appearance, FIG. 11 discloses the 'Sequencing set-up' as SEQ ID NOS 2325, 2332, 2340, 2334, 2333 and 2327, respectively, in order of appearance.

FIG. 14 is a gel electrophoresis showing ligation of an adapter sequence in either a tube (T) or an emulsion droplet (E).

FIG. 18 is a schematic depicting the methodology for informatically deriving mate pairs.

FIG. 21 shows a determination of the optimal ratio of genomic Index:genomic DNA.

FIG. 28 shows impact of ligation efficiency on bioinformatics end association.

FIG. 29 discloses SEQ ID NOS 2341-2350, 2350, 2349, 2348, 2347, 2346, 2345, 2344, 2343 and 2342, respectively, in order of appearance.

FIG. 36 shows amplification of fragment ends via transposome-based selection.

FIG. 37a discloses SEQ ID NOS 2351-2353, respectively, in order of appearance. FIG. 37b discloses SEQ ID NOS 2351, 2352, 2354-2357, 2357, 2354, 2355, 2358, 2359, 2356 and 2360, respectively, in order of appearance.

FIG. 39 discloses SEQ ID NOS 2351-2352 and 2361, respectively, in order of appearance.

DETAILED DESCRIPTION OF INVENTION

Figure 1A:
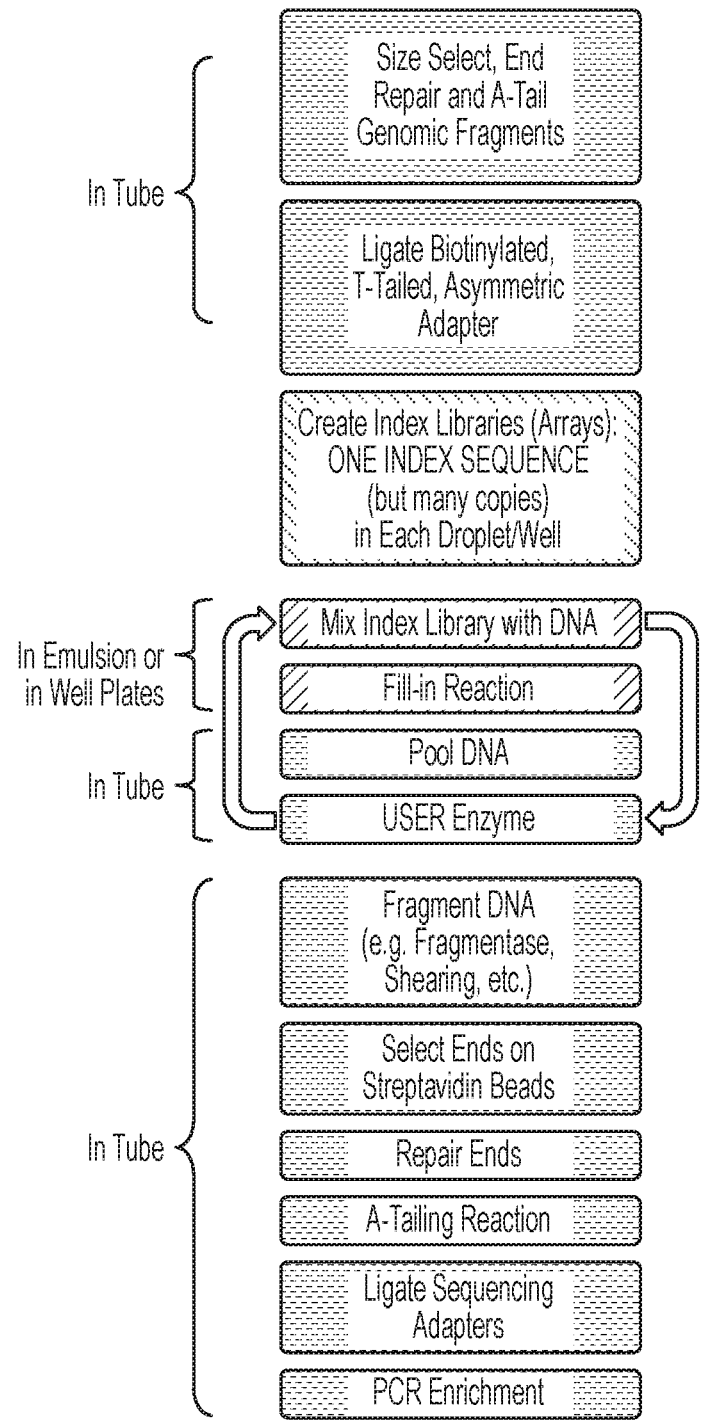
Figure 1B:
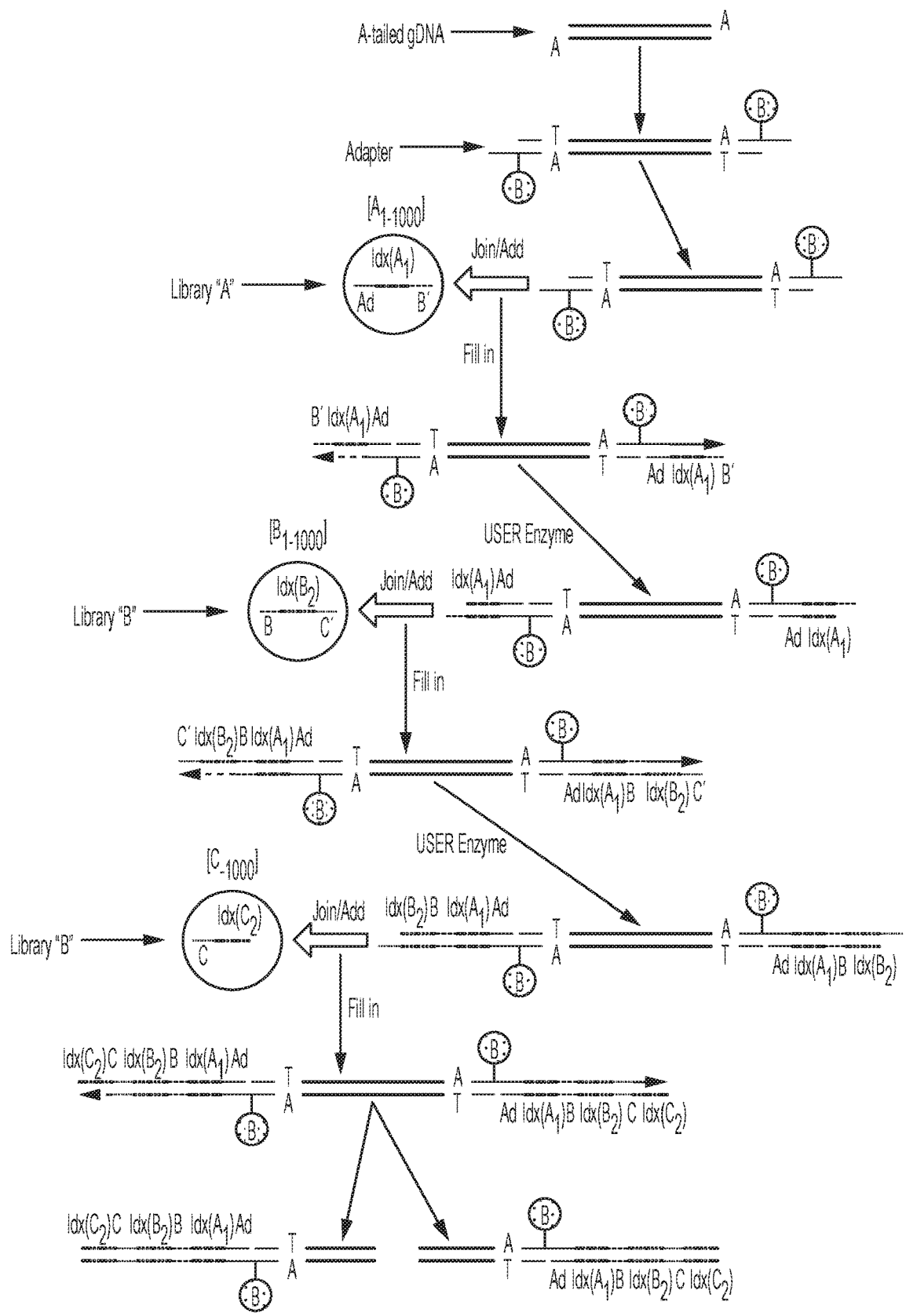

The invention provides methods and compositions for uniquely labeling agents of interest including for example nucleic acids, such as DNA, peptides or proteins, cells, chemicals, etc. The ability to uniquely label agents has a number of applications, as contemplated by the invention, including but not limited to genomic sequencing, genomic assembly, screening of putative drugs and biologics, analysis of environmental samples to discover new organisms, labeling of individual elements of synthetic biology constructs, quality control analysis of reagents to verify purity, and analysis of downstream effects of various conditions on cells or cell components, etc. One of the major limitations of prior art labeling techniques is the limited number of available unique labels. Typically the number of agents to be labeled in any given application far exceeds the number of unique labels that are available. The methods of the invention can be used to synthesize essentially an infinite number of unique labels. Moreover, because of their nature, the labels can be easily detected and distinguished from each other, making them suitable for many applications and uses.

The methods of the invention easily and efficiently generate libraries of unique labels. Such libraries may be of any size, and are preferably large libraries including hundreds of thousands to billions of unique labels. The libraries of unique labels may be synthesized separately from agents and then associated with agents post-synthesis. Alternatively, unique labels may be synthesized in real-time (e.g., while in the presence of the agent) and in some instances the label synthesis is a function of the history of the agent. This means, in some instances, that synthesis of the label may occur while an agent is being exposed to one or more conditions. The invention therefore contemplates that the resultant label may store (or code) within it information about the agent (i.e., agent-specific information) including the origin or source of the agent, the relatedness of the agent to other agents, the genomic distance between two agents (e.g., in the case of genomic fragments), conditions to which the agent may have been exposed, and the like.

Some methods of the invention may comprise determining information about an agent based on the unique label associated with the agent. In some instances, determining information about the agent may comprise obtaining the nucleotide sequence of the unique label (i.e., sequencing the unique label). In other instances, determining information about the agent may comprise determining the presence, number and/or order of non-nucleic acid detectable moieties. In still other instances, determining information about the agent may comprise obtaining the nucleotide sequence of the unique label and determining the presence, number and/or order of non-nucleic acid detectable moieties. Methods for nucleic acid sequencing and detection of non-nucleic acid detectable moieties are known in the art and are described herein.

As used herein, "agent" or "agents" refers to any moiety or entity that can be associated with, including attached to, a unique label. An agent may be a single entity or it may be a plurality of entities. An agent may be a nucleic acid, a peptide, a protein, a cell, a cell lysate, a solid support, a polymer, a chemical, and the like, or an agent may be a plurality of any of the foregoing, or it may be a mixture of any of the foregoing. As an example, an agent may be nucleic acids (e.g., mRNA transcripts and/or genomic DNA fragments), solid supports such as beads or polymers, and/or proteins from a single cell or from a single cell population (e.g., a tumor or non-tumor tissue sample).

In some important embodiments, an agent is a nucleic acid. The nucleic acid agent may be single-stranded (ss) or double-stranded (ds), or it may be partially single-stranded and partially double-stranded. Nucleic acid agents include but are not limited to DNA such as genomic DNA fragments, PCR and other amplification products, RNA, cDNA, and the like. Nucleic acid agents may he fragments of larger nucleic acids such as but not limited to genomic DNA fragments.

Association of Labels and Agents

An agent of interest may be associated with a unique label. As used herein, "associated" refers to a relationship between the agent and the unique label such that the unique label may be used to identify the agent, identify the source or origin of the agent, identify one or more conditions to which the agent has been exposed, etc. A label that is associated with an agent may be, for example, physically attached to the agent, either directly or indirectly, or it may be in the same defined, typically physically separate, volume as the agent. A defined volume may be an emulsion droplet, a well (of for example a multiwell plate), a tube, a container, and the like. It is to be understood that the defined volume will typically contain only one agent and the label with which it is associated, although a volume containing multiple agents with multiple copies of the label is also contemplated depending on the application.

An agent may be associated with a single copy of a unique label or it may be associated with multiple copies of the same unique label including for example 2, 3, 4, 5, 6, 7, 8, 9, 10, 100, 1000, 10,000, 100,000 or more copies of the same unique label, In this context, the label is considered unique because it is different from labels associated with other, different agents.

Attachment of labels to agents may be direct or indirect. The attachment chemistry will depend on the nature of the agent and/or any derivatisation or functionalisation applied to the agent. For example, labels can be directly attached through covalent attachment. The label may include a moiety, which may be a non-nucleotide chemical modification, to facilitate attachment. By way of non-limiting example, the label may include methylated nucleotides, uracil bases, phosphorothioate groups, ribonucleotides, diol linkages, disulphide linkages, etc., to enable covalent attachment to an agent.

In another example, a label can be attached to an agent via a linker or in another indirect manner. Examples of linkers, include, but are not limited to, carbon-containing chains, polyethylene glycol (PEG), nucleic acids, monosaccharide units, and peptides. The linkers may be cleavable under certain conditions. Cleavable linkers are discussed in greater detail herein.

Methods for attaching nucleic acids to each other, as for example attaching nucleic acid labels to nucleic acid agents, are known in the art. Such methods include but are not limited to ligation, such as blunt end ligation or cohesive overhang ligation, and polymerase-mediated attachment methods (see, e.g., U.S. Patent Nos. 7863058 and 7754429; Green and Sambrook. Molecular Cloning: A Laboratory Manual, Fourth Edition, 2012; Current Protocols in Molecular Biology, and Current Protocols in Nucleic Acid Chemistry, all of which are incorporated herein by reference).

In some embodiments, oligonucleotide adapters are used to attach a unique label to an agent or to a solid support. In some embodiments, an oligonucleotide adapter may comprise one or more known sequences, e.g., an amplification sequence, a capture sequence, a primer sequence, and the like. In some embodiments, the adapter may comprise a thymidine (T) tail overhang. Methods for producing a thymidine tail overhang are known in the art, e.g., using terminal deoxynucleotide transferase (TdT) or a polymerase that adds a thymidine overhang at the termination of polymerization. In some embodiments, the oligonucleotide adapter may comprise a region that is forked. Examples of forked oligonucleotide adapters are described in Example 6.

In some embodiments, the adapter may comprise a capture or detection moiety. Examples of such moieties include, but are not limited to, fluorophores, microparticles such as quantum dots (Empodocles, et al., Nature 399:126-130, 1999), gold nanoparticles (Reichert et al, Anal. Chem, 72:6025-6029, 2000), microbeads (Lacoste et al, Proc. Natl. Acad. Sci. USA 97(17):9461-9466, 2000), biotin, DNP (dinitrophenyl), fucose, digoxigenin, and other moieties known to those skilled in the art. In some embodiments, the moiety is biotin.

A label and/or an agent may be attached to a solid support. In some instances, a label (or multiple copies of the same label) and the agent are attached to the same solid support. Examples of suitable solid supports include, but are not limited to, inert polymers (preferably non-nucleic acid polymers), beads, glass, or peptides. In some embodiments, the solid support is an inert polymer or a bead. The solid support may be functionalised to permit covalent attachment of the agent and/or label. Such functionalisation may comprise placing on the solid support reactive groups that permit covalent attachment to an agent and/or a label.

Labels and/or agents may be attached to each other or to solid supports using cleavable linkers. Cleavable linkers are known in the art and include, but are not limited to, TEV, trypsin, thrombin, cathepsin B, cathespin D, cathepsin K, caspase lumatrix metalloproteinase sequences, phosphodiester, phospholipid, ester,β-galactose, dialkyl dialkoxysilane, cyanoethyl group, sulfone, ethylene glycolyl disuccinate, 2-N-acyl nitrobenzenesulfonamide, a-thiophenylester, unsaturated vinyl sulfide, sulfonamide after activation, malondialdehyde (MDA)-indole derivative, levulinoyl ester, hydrazone, acylhydrazone, alkyl thioester, disulfide bridges, azo compounds, 2-Nitrobenzyl derivatives, phenacyl ester, 8-quinolinyl benzenesulfonate, coumarin, phosphotriester, bis-arylhydrazone, bimane bi-thiopropionic aciddertivative, paramethoxybenzyl derivative, test-butylcarbamate analogue, dialkyl or diaryl dialkoxysilane, orthoester, acetal, aconityl, hydrazone, thiopropionate, phosphoramidate, imine, trityl, vinyl ether, polyketal, alkyl 2-(diphenylphosphino)benzoate derivatives, allyl ester, 8-hydroxyquinoline ester, picolinate ester, vicinal diols, and selenium compounds (see, e.g. Leriche G, Chisholm L, Wagner A. Cleavable Linkers in Chemical Biology. Bioorg Med Chem. 15;20(2):571-82. 2012, which is incorporated herein by reference). Cleavage conditions and reagents include, but are not limited to, enzymes, nucleophilic/basic reagents, reducing agents, photo-irradiation, electrophilic/acidic reagents, organometallic and metal reagents, and oxidizing reagents.

Detectable Oligonucleotide Tags

The unique labels of the invention are, at least in part, nucleic acid in nature, and are generated by sequentially attaching two or more detectable oligonucleotide tags to each other. As used herein, a detectable oligonucleotide tag is an oligonucleotide that can be detected by sequencing of its nucleotide sequence and/or by detecting non-nucleic acid detectable moieties it may be attached to.

The oligonucleotide tags are typically randomly selected from a diverse plurality of oligonucleotide tags. In some instances, an oligonucleotide tag may be present once in a plurality or it may be present multiple times in a plurality. In the latter instance, the plurality of tags may be comprised of a number of subsets each which may comprise a plurality of identical tags. In some important embodiments, these subsets are physically separate from each other. Physical separation may be achieved by providing the subsets in separate wells of a multiwell plate or separate droplets from an emulsion. It is the random selection and thus combination of oligonucleotide tags that results in a unique label. Accordingly, the number of distinct (i.e., different) oligonucleotide tags required to uniquely label a plurality of agents can be far less than the number of agents being labeled. This is particularly advantageous when the number of agents is large (e.g., when the agents are members of a library).

The oligonucleotide tags may be detectable by virtue of their nucleotide sequence, or by virtue of a non-nucleic acid detectable moiety that is attached to the oligonucleotide such as but not limited to a fluorophore, or by virtue of a combination of their nucleotide sequence and the non-nucleic acid detectable moiety.

As used herein, the term "oligonucleotide" refers to a nucleic acid such as deoxyribonucleic acid (DNA), ribonucleic acid (RNA), or DNA/RNA hybrids and includes analogs of either DNA or RNA made from nucleotide analogs known in the art (see, e.g. U.S. Patent or Patent Application Publications: U.S. Pat. Nos. 7,399,845, 7,741, 457, 8,022,193, 7,569,686, 7,335,765, 7,314,923, 7,335,765, and 7,816,333, US 20110009471, the entire contents of each of which are incorporated herein by reference). Oligonucleotides may be single-stranded (such as sense or antisense oligonucleotides), double-stranded, or partially single-stranded and partially double-stranded.

In some embodiments, a detectable oligonucleotide tag may comprise one or more non-oligonucleotide detectable moieties. Examples of detectable moieties include, but are not limited to, fluorophores, microparticles including quantum dots (Empodocles, et al., Nature 399:126-130, 1999), gold nanoparticles (Reichert et al., Anal. Chem, 72:6025-6029, 2000), microbeads (Lacoste et al., Proc. Natl. Acad. Sci. USA 97(17):9461-9466, 2000), biotin, DNP (dinitrophenyl), fucose, digoxigenin, haptens, and other detectable moieties known to those skilled in the art. In some embodiments, the detectable moieties are quantum dots. Methods for detecting such moieties are described herein and/or are known in the art.

Thus, detectable oligonucleotide tags may be, but are not limited to, oligonucleotides which may comprise unique nucleotide sequences, oligonucleotides which may comprise detectable moieties, and oligonucleotides which may comprise both unique nucleotide sequences and detectable moieties.

A unique nucleotide sequence may be a nucleotide sequence that is different (and thus distinguishable) from the sequence of each detectable oligonucleotide tag in a plurality of detectable oligonucleotide tags. A unique nucleotide sequence may also be a nucleotide sequence that is different (and thus distinguishable) from the sequence of each detectable oligonucleotide tag in a first plurality of detectable oligonucleotide tags but identical to the sequence of at least one detectable oligonucleotide tag in a second plurality of detectable oligonucleotide tags. A unique sequence may differ from other sequences by multiple bases (or base pairs). The multiple bases may be contiguous or non-contiguous. Methods for obtaining nucleotide sequences (e.g., sequencing methods) are described herein and/or are known in the art.

In some embodiments, detectable oligonucleotide tags may comprise one or more of a ligation sequence, a priming sequence, a capture sequence, and a unique sequence (optionally referred to herein as an index sequence). A ligation sequence is a sequence complementary to a second nucleotide sequence which allows for ligation of the detectable oligonucleotide tag to another entity which may comprise the second nucleotide sequence, e.g., another detectable oligonucleotide tag or an oligonucleotide adapter. A priming sequence is a sequence complementary to a primer, e.g., an oligonucleotide primer used for an amplification reaction such as but not limited to PCR. A capture sequence is a sequence capable of being bound by a capture entity. A capture entity may be an oligonucleotide which may comprise a nucleotide sequence complementary to a capture sequence, e.g. a second detectable oligonucleotide tag or an oligonucleotide attached to a bead. A capture entity may also be any other entity capable of binding to the capture sequence, e.g., an antibody or peptide. An index sequence is a sequence which may comprise a unique nucleotide sequence and/or a detectable moiety as described above.

"Complementary" is a term which is used to indicate a sufficient degree of complementarily between two nucleotide sequences such that stable and specific binding occurs between one and preferably more bases (or nucleotides, as the terms are used interchangeably herein) of the two sequences. For example, if a nucleotide in a first nucleotide sequence is capable of hydrogen bonding with a nucleotide in second nucleotide sequence, then the bases are considered to be complementary to each other. Complete (i.e., 100%) complementarity between a first nucleotide sequence and a second nucleotide is preferable, but not required for ligation, priming, or capture sequences.

Table 1 below provides examples of certain oligonucleotide tags of the invention:

TABLE 1

| SEQ ID NO: | Tag | SEQ ID NO: | Full Oligo Sequence (Top) | SEQ ID NO: | Full Oligo Sequence (Bot) |
|---|---|---|---|---|---|
| 1 | GGATATCTGTGGATATCTGT | 769 | /5Phos/CAGAGGATATCTGTGGATATCTGT | 1537 | /5Phos/CGAAACAGATATCCACAGATATCC |
| 2 | GGCTGCCATAGGCTGCCATA | 770 | /5Phos/CAGAGGCTGCCATAGGCTGCCATA | 1538 | /5Phos/CGAATATGGCAGCCTATGGCAGCC |
| 3 | GGTATGTCAAGGTATGTCAA | 771 | /5Phos/CAGAGGTATGTCAAGGTATGTCAA | 1539 | /5Phos/CGAATTGACATACCTTGACATACC |
| 4 | GGTGAAGGACGGTGAAGGAC | 772 | /5Phos/CAGAGGTGAAGGACGGTGAAGGAC | 1540 | /5Phos/CGAAGTCCTTCACCGTCCTTCACC |
| 5 | GTACCAGCATGTACCAGCAT | 773 | /5Phos/CAGAGTACCAGCATGTACCAGCAT | 1541 | /5Phos/CGAAATGCTGGTACATGCTGGTAC |
| 6 | GTATACATCCGTATACATCC | 774 | /5Phos/CAGAGTATACATCCGTATACATCC | 1542 | /5Phos/CGAAGGATGTATACGGATGTATAC |
| 7 | GTATCGCTCAGTATCGCTCA | 775 | /5Phos/CAGAGTATCGCTCAGTATCGCTCA | 1543 | /5Phos/CGAATGAGCGATACTGAGCGATAC |
| 8 | GTCCGATGGAGTCCGATGGA | 776 | /5Phos/CAGAGTCCGATGGAGTCCGATGGA | 1544 | /5Phos/CGAATCCATCGGACTCCATCGGAC |
| 9 | GTGTGGAATTGTGTGGAATT | 777 | /5Phos/CAGAGTGTGGAATTGTGTGGAATT | 1545 | /5Phos/CGAAAATTCCACACAATTCCACAC |
| 10 | GTGTGGCAGAGTGTGGCAGA | 778 | /5Phos/CAGAGTGTGGCAGAGTGTGGCAGA | 1546 | /5Phos/CGAATCTGCCACACTCTGCCACAC |
| 11 | GTTACGGTGAGTTACGGTGA | 779 | /5Phos/CAGAGTTACGGTGAGTTACGGTGA | 1547 | /5Phos/CGAATCACCGTAACTCACCGTAAC |
| 12 | GTTCGTACATGTTCGTACAT | 780 | /5Phos/CAGAGTTCGTACATGTTCGTACAT | 1548 | /5Phos/CGAAATGTACGAACATGTACGAAC |
| 13 | TAACCGGTAATAACCGGTAA | 781 | /5Phos/CAGATAACCGGTAATAACCGGTAA | 1549 | /5Phos/CGAATTACCGGTTATTACCGGTTA |
| 14 | TACAGAGTCATACAGAGTCA | 782 | /5Phos/CAGATACAGAGTCATACAGAGTCA | 1550 | /5Phos/CGAATGACTCTGTATGACTCTGTA |
| 15 | TACCGAGATATACCGAGATA | 783 | /5Phos/CAGATACCGAGATATACCGAGATA | 1551 | /5Phos/CGAATATCTCGGTATATCTCGGTA |
| 16 | TACGCATCGCTACGCATCGC | 784 | /5Phos/CAGATACGCATCGCTACGCATCGC | 1552 | /5Phos/CGAAGCGATGCGTAGCGATGCGTA |
| 17 | TACGCGCTTGTACGCGCTTG | 785 | /5Phos/CAGATACGCGCTTGTACGCGCTTG | 1553 | /5Phos/CGAACAAGCGCGTACAAGCGCGTA |
| 18 | TAGACTTCACTAGACTTCAC | 786 | /5Phos/CAGATAGACTTCACTAGACTTCAC | 1554 | /5Phos/CGAAGTGAAGTCTAGTGAAGTCTA |
| 19 | TATCGCTTAGTATCGCTTAG | 787 | /5Phos/CAGATATCGCTTAGTATCGCTTAG | 1555 | /5Phos/CGAACTAAGCGATACTAAGCGATA |
| 20 | TCACGATCCGTCACGATCCG | 788 | /5Phos/CAGATCACGATCCGTCACGATCCG | 1556 | /5Phos/CGAACGGATCGTGACGGATCGTGA |
| 21 | TCAGCTTCGCTCAGCTTCGC | 789 | /5Phos/CAGATCAGCTTCGCTCAGCTTCGC | 1557 | /5Phos/CGAAGCGAAGCTGAGCGAAGCTGA |
| 22 | TCCGGACTTCTCCGGACTTC | 790 | /5Phos/CAGATCCGGACTTCTCCGGACTTC | 1558 | /5Phos/CGAAGAAGTCCGGAGAAGTCCGGA |
| 23 | TCCGGTATGGTCCGGTATGG | 791 | /5Phos/CAGATCCGGTATGGTCCGGTATGG | 1559 | /5Phos/CGAACCATACCGGACCATACCGGA |
| 24 | TCCGTGGTGATCCGTGGTGA | 792 | /5Phos/CAGATCCGTGGTGATCCGTGGTGA | 1560 | /5Phos/CGAATCACCACGGATCACCACGGA |
| 25 | TCCTCATCCATCCTCATCCA | 793 | /5Phos/CAGATCCTCATCCATCCTCATCCA | 1561 | /5Phos/CGAATGGATGAGGATGGATGAGGA |
| 26 | TCCTTCTGGATCCTTCTGGA | 794 | /5Phos/CAGATCCTTCTGGATCCTTCTGGA | 1562 | /5Phos/CGAATCCAGAAGGATCCAGAAGGA |
| 27 | TCGCTGTTGCTCGCTGTTGC | 795 | /5Phos/CAGATCGCTGTTGCTCGCTGTTGC | 1563 | /5Phos/CGAAGCAACAGCGAGCAACAGCGA |
| 28 | TCGGAGCTTGTCGGAGCTTG | 796 | /5Phos/CAGATCGGAGCTTGTCGGAGCTTG | 1564 | /5Phos/CGAACAAGCTCCGACAAGCTCCGA |
| 29 | TCGGCATGAGTCGGCATGAG | 797 | /5Phos/CAGATCGGCATGAGTCGGCATGAG | 1565 | /5Phos/CGAACTCATGCCGACTCATGCCGA |
| 30 | TCGGTGGAACTCGGTGGAAC | 798 | /5Phos/CAGATCGGTGGAACTCGGTGGAAC | 1566 | /5Phos/CGAAGTTCCACCGAGTTCCACCGA |
| 31 | TCGGTTGTAATCGGTTGTAA | 799 | /5Phos/CAGATCGGTTGTAATCGGTTGTAA | 1567 | /5Phos/CGAATTACAACCGATTACAACCGA |
| 32 | TCGTGTGGCATCGTGTGGCA | 800 | /5Phos/CAGATCGTGTGGCATCGTGTGGCA | 1568 | /5Phos/CGAATGCCACACGATGCCACACGA |
| 33 | TCTGTTCCGCTCTGTTCCGC | 801 | /5Phos/CAGATCTGTTCCGCTCTGTTCCGC | 1569 | /5Phos/CGAAGCGGAACAGAGCGGAACAGA |
| 34 | TCTTGGCGTCTCTTGGCGTC | 802 | /5Phos/CAGATCTTGGCGTCTCTTGGCGTC | 1570 | /5Phos/CGAAGACGCCAAGAGACGCCAAGA |
| 35 | TGATTGAGTCTGATTGAGTC | 803 | /5Phos/CAGATGATTGAGTCTGATTGAGTC | 1571 | /5Phos/CGAAGACTCAATCAGACTCAATCA |
| 36 | TGCGTTGGCATGCGTTGGCA | 804 | /5Phos/CAGATGCGTTGGCATGCGTTGGCA | 1572 | /5Phos/CGAATGCCAACGCATGCCAACGCA |
| 37 | TGGACATGCGTGGACATGCG | 805 | /5Phos/CAGATGGACATGCGTGGACATGCG | 1573 | /5Phos/CGAACGCATGTCCACGCATGTCCA |
| 38 | TGGCAAGCCATGGCAAGCCA | 806 | /5Phos/CAGATGGCAAGCCATGGCAAGCCA | 1574 | /5Phos/CGAATGGCTTGCCATGGCTTGCCA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 39 | TGGTTAACTGTGGTTAACTG | 807 | /5Phos/CAGATGGTTAACTGTGGTTAACTG | 1575 | /5Phos/CGAACAGTTAACCACAGTTAACCA |
| 40 | TGTACCTGAGTGTACCTGAG | 808 | /5Phos/CAGATGTACCTGAGTGTACCTGAG | 1576 | /5Phos/CGAACTCAGGTACACTCAGGTACA |
| 41 | TGTACTACAGTGTACTACAG | 809 | /5Phos/CAGATGTACTACAGTGTACTACAG | 1577 | /5Phos/CGAACTGTAGTACACTGTAGTACA |
| 42 | TGTCGGTTGCTGTCGGTTGC | 810 | /5Phos/CAGATGTCGGTTGCTGTCGGTTGC | 1578 | /5Phos/CGAAGCAACCGACAGCAACCGACA |
| 43 | TGTCTGTCGGTGTCTGTCGG | 811 | /5Phos/CAGATGTCTGTCGGTGTCTGTCGG | 1579 | /5Phos/CGAACCGACAGACACCGACAGACA |
| 44 | TGTGACTATCTGTGACTATC | 812 | /5Phos/CAGATGTGACTATCTGTGACTATC | 1580 | /5Phos/CGAAGATAGTCACAGATAGTCACA |
| 45 | TGTGAGTGCGTGTGAGTGCG | 813 | /5Phos/CAGATGTGAGTGCGTGTGAGTGCG | 1581 | /5Phos/CGAACGCACTCACACGCACTCACA |
| 46 | TGTGGTTCGCTGTGGTTCGC | 814 | /5Phos/CAGATGTGGTTCGCTGTGGTTCGC | 1582 | /5Phos/CGAAGCGAACCACAGCGAACCACA |
| 47 | TGTTCTCTACTGTTCTCTAC | 815 | /5Phos/CAGATGTTCTCTACTGTTCTCTAC | 1583 | /5Phos/CGAAGTAGAGAACAGTAGAGAACA |
| 48 | TTAGCCAGTCTTAGCCAGTC | 816 | /5Phos/CAGATTAGCCAGTCTTAGCCAGTC | 1584 | /5Phos/CGAAGACTGGCTAAGACTGGCTAA |
| 49 | TTCGCGAATATTCGCGAATA | 817 | /5Phos/CAGATTCGCGAATATTCGCGAATA | 1585 | /5Phos/CGAATATTCGCGAATATTCGCGAA |
| 50 | TTCGCGGTACTTCGCGGTAC | 818 | /5Phos/CAGATTCGCGGTACTTCGCGGTAC | 1586 | /5Phos/CGAAGTACCGCGAAGTACCGCGAA |
| 51 | TTCTATGCAGTTCTATGCAG | 819 | /5Phos/CAGATTCTATGCAGTTCTATGCAG | 1587 | /5Phos/CGAACTGCATAGAACTGCATAGAA |
| 52 | TTCTTACCGATTCTTACCGA | 820 | /5Phos/CAGATTCTTACCGATTCTTACCGA | 1588 | /5Phos/CGAATCGGTAAGAATCGGTAAGAA |
| 53 | TTGCTCTGGATTGCTCTGGA | 821 | /5Phos/CAGATTGCTCTGGATTGCTCTGGA | 1589 | /5Phos/CGAATCCAGAGCAATCCAGAGCAA |
| 54 | TTGTAACACCTTGTAACACC | 822 | /5Phos/CAGATTGTAACACCTTGTAACACC | 1590 | /5Phos/CGAAGGTGTTACAAGGTGTTACAA |
| 55 | AACAAGTTCCAACAAGTTCC | 823 | /5Phos/CAGAAACAAGTTCCAACAAGTTCC | 1591 | /5Phos/CGAAGGAACTTGTTGGAACTTGTT |
| 56 | AACAGCACGCAACAGCACGC | 824 | /5Phos/CAGAAACAGCACGCAACAGCACGC | 1592 | /5Phos/CGAAGCGTGCTGTTGCGTGCTGTT |
| 57 | AACGTGCGGTAACGTGCGGT | 825 | /5Phos/CAGAAACGTGCGGTAACGTGCGGT | 1593 | /5Phos/CGAAACCGCACGTTACCGCACGTT |
| 58 | AAGAGCGATGAAGAGCGATG | 826 | /5Phos/CAGAAAGAGCGATGAAGAGCGATG | 1594 | /5Phos/CGAACATCGCTCTTCATCGCTCTT |
| 59 | AAGGAATTCCAAGGAATTCC | 827 | /5Phos/CAGAAAGGAATTCCAAGGAATTCC | 1595 | /5Phos/CGAAGGAATTCCTTGGAATTCCTT |
| 60 | AAGTGAGGCGAAGTGAGGCG | 828 | /5Phos/CAGAAAGTGAGGCGAAGTGAGGCG | 1596 | /5Phos/CGAACGCCTCACTTCGCCTCACTT |
| 61 | AATACGCGATAATACGCGAT | 829 | /5Phos/CAGAAATACGCGATAATACGCGAT | 1597 | /5Phos/CGAAATCGCGTATTATCGCGTATT |
| 62 | AATAGGTTGGAATAGGTTGG | 830 | /5Phos/CAGAAATAGGTTGGAATAGGTTGG | 1598 | /5Phos/CGAACCAACCTATTCCAACCTATT |
| 63 | AATCGAAGCTAATCGAAGCT | 831 | /5Phos/CAGAAATCGAAGCTAATCGAAGCT | 1599 | /5Phos/CGAAAGCTTCGATTAGCTTCGATT |
| 64 | ACACTACGATACACTACGAT | 832 | /5Phos/CAGAACACTACGATACACTACGAT | 1600 | /5Phos/CGAAATCGTAGTGTATCGTAGTGT |
| 65 | ACACTCAGCCACACTCAGCC | 833 | /5Phos/CAGAACACTCAGCCACACTCAGCC | 1601 | /5Phos/CGAAGGCTGAGTGTGGCTGAGTGT |
| 66 | ACATCGAGCCACATCGAGCC | 834 | /5Phos/CAGAACATCGAGCCACATCGAGCC | 1602 | /5Phos/CGAAGGCTCGATGTGGCTCGATGT |
| 67 | ACATTATGCGACATTATGCG | 835 | /5Phos/CAGAACATTATGCGACATTATGCG | 1603 | /5Phos/CGAACGCATAATGTCGCATAATGT |
| 68 | ACCAGCAACTACCAGCAACT | 836 | /5Phos/CAGAACCAGCAACTACCAGCAACT | 1604 | /5Phos/CGAAAGTTGCTGGTAGTTGCTGGT |
| 69 | ACCGAACACGACCGAACACG | 837 | /5Phos/CAGAACCGAACACGACCGAACACG | 1605 | /5Phos/CGAACGTGTTCGGTCGTGTTCGGT |
| 70 | ACCGAACGGTACCGAACGGT | 838 | /5Phos/CAGAACCGAACGGTACCGAACGGT | 1606 | /5Phos/CGAAACCGTTCGGTACCGTTCGGT |
| 71 | ACGAGTGGCTACGAGTGGCT | 839 | /5Phos/CAGAACGAGTGGCTACGAGTGGCT | 1607 | /5Phos/CGAAAGCCACTCGTAGCCACTCGT |
| 72 | ACGGTTACGGACGGTTACGG | 840 | /5Phos/CAGAACGGTTACGGACGGTTACGG | 1608 | /5Phos/CGAACCGTAACCGTCCGTAACCGT |
| 73 | ACGTAAGCGCACGTAAGCGC | 841 | /5Phos/CAGAACGTAAGCGCACGTAAGCGC | 1609 | /5Phos/CGAAGCGCTTACGTGCGCTTACGT |
| 74 | ACTATGTGCTACTATGTGCT | 842 | /5Phos/CAGAACTATGTGCTACTATGTGCT | 1610 | /5Phos/CGAAAGCACATAGTAGCACATAGT |
| 75 | ACTGGAGTCCACTGGAGTCC | 843 | /5Phos/CAGAACTGGAGTCCACTGGAGTCC | 1611 | /5Phos/CGAAGGACTCCAGTGGACTCCAGT |
| 76 | ACTGTACTTCACTGTACTTC | 844 | /5Phos/CAGAACTGTACTTCACTGTACTTC | 1612 | /5Phos/CGAAGAAGTACAGTGAAGTACAGT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 77 | AGAAGTCTGCAGAAGTCTGC | 845 | /5Phos/CAGAAGAAGTCTGCAGAAGTCTGC | 1613 | /5Phos/CGAAGCAGACTTCTGCAGACTTCT |
| 78 | AGACGCGAGTAGACGCGAGT | 846 | /5Phos/CAGAAGACGCGAGTAGACGCGAGT | 1614 | /5Phos/CGAAACTCGCGTCTACTCGCGTCT |
| 79 | AGACTGTGCTAGACTGTGCT | 847 | /5Phos/CAGAAGACTGTGCTAGACTGTGCT | 1615 | /5Phos/CGAAAGCACAGTCTAGCACAGTCT |
| 80 | AGAGTACGCCAGAGTACGCC | 848 | /5Phos/CAGAAGAGTACGCCAGAGTACGCC | 1616 | /5Phos/CGAAGGCGTACTCTGGCGTACTCT |
| 81 | AGATCGACTGAGATCGACTG | 849 | /5Phos/CAGAAGATCGACTGAGATCGACTG | 1617 | /5Phos/CGAACAGTCGATCTCAGTCGATCT |
| 82 | AGATTCGGCCAGATTCGGCC | 850 | /5Phos/CAGAAGATTCGGCCAGATTCGGCC | 1618 | /5Phos/CGAAGGCCGAATCTGGCCGAATCT |
| 83 | AGCAAGTGCTAGCAAGTGCT | 851 | /5Phos/CAGAAGCAAGTGCTAGCAAGTGCT | 1619 | /5Phos/CGAAAGCACTTGCTAGCACTTGCT |
| 84 | AGCCATTGCGAGCCATTGCG | 852 | /5Phos/CAGAAGCCATTGCGAGCCATTGCG | 1620 | /5Phos/CGAACGCAATGGCTCGCAATGGCT |
| 85 | AGCGGACAGTAGCGGACAGT | 853 | /5Phos/CAGAAGCGGACAGTAGCGGACAGT | 1621 | /5Phos/CGAAACTGTCCGCTACTGTCCGCT |
| 86 | AGCGTAAGCGAGCGTAAGCG | 854 | /5Phos/CAGAAGCGTAAGCGAGCGTAAGCG | 1622 | /5Phos/CGAACGCTTACGCTCGCTTACGCT |
| 87 | AGCTATTCTCAGCTATTCTC | 855 | /5Phos/CAGAAGCTATTCTCAGCTATTCTC | 1623 | /5Phos/CGAAGAGAATAGCTGAGAATAGCT |
| 88 | AGCTTATACGAGCTTATACG | 856 | /5Phos/CAGAAGCTTATACGAGCTTATACG | 1624 | /5Phos/CGAACGTATAAGCTCGTATAAGCT |
| 89 | AGGACAGATGAGGACAGATG | 857 | /5Phos/CAGAAGGACAGATGAGGACAGATG | 1625 | /5Phos/CGAACATCTGTCCTCATCTGTCCT |
| 90 | AGGATCAGATAGGATCAGAT | 858 | /5Phos/CAGAAGGATCAGATAGGATCAGAT | 1626 | /5Phos/CGAAATCTGATCCTATCTGATCCT |
| 91 | AGGCTGAAGGAGGCTGAAGG | 859 | /5Phos/CAGAAGGCTGAAGGAGGCTGAAGG | 1627 | /5Phos/CGAACCTTCAGCCTCCTTCAGCCT |
| 92 | AGGTACGAGGAGGTACGAGG | 860 | /5Phos/CAGAAGGTACGAGGAGGTACGAGG | 1628 | /5Phos/CGAACCTCGTACCTCCTCGTACCT |
| 93 | AGGTAGGCTCAGGTAGGCTC | 861 | /5Phos/CAGAAGGTAGGCTCAGGTAGGCTC | 1629 | /5Phos/CGAAGAGCCTACCTGAGCCTACCT |
| 94 | AGGTGAACGGAGGTGAACGG | 862 | /5Phos/CAGAAGGTGAACGGAGGTGAACGG | 1630 | /5Phos/CGAACCGTTCACCTCCGTTCACCT |
| 95 | AGGTGCCAATAGGTGCCAAT | 863 | /5Phos/CAGAAGGTGCCAATAGGTGCCAAT | 1631 | /5Phos/CGAAATTGGCACCTATTGGCACCT |
| 96 | AGGTTCAACGAGGTTCAACG | 864 | /5Phos/CAGAAGGTTCAACGAGGTTCAACG | 1632 | /5Phos/CGAACGTTGAACCTCGTTGAACCT |
| 97 | AGTCACTCGCAGTCACTCGC | 865 | /5Phos/CAGAAGTCACTCGCAGTCACTCGC | 1633 | /5Phos/CGAAGCGAGTGACTGCGAGTGACT |
| 98 | AGTCGTGGTGAGTCGTGGTG | 866 | /5Phos/CAGAAGTCGTGGTGAGTCGTGGTG | 1634 | /5Phos/CGAACACCACGACTCACCACGACT |
| 99 | AGTGGAGGAGAGTGGAGGAG | 867 | /5Phos/CAGAAGTGGAGGAGAGTGGAGGAG | 1635 | /5Phos/CGAACTCCTCCACTCTCCTCCACT |
| 100 | AGTTGAGCGCAGTTGAGCGC | 868 | /5Phos/CAGAAGTTGAGCGCAGTTGAGCGC | 1636 | /5Phos/CGAAGCGCTCAACTGCGCTCAACT |
| 101 | AGTTGATGGTAGTTGATGGT | 869 | /5Phos/CAGAAGTTGATGGTAGTTGATGGT | 1637 | /5Phos/CGAAACCATCAACTACCATCAACT |
| 102 | ATAACACAGCATAACACAGC | 870 | /5Phos/CAGAATAACACAGCATAACACAGC | 1638 | /5Phos/CGAAGCTGTGTTATGCTGTGTTAT |
| 103 | ATAAGGTCCGATAAGGTCCG | 871 | /5Phos/CAGAATAAGGTCCGATAAGGTCCG | 1639 | /5Phos/CGAACGGACCTTATCGGACCTTAT |
| 104 | ATACAGTCAGATACAGTCAG | 872 | /5Phos/CAGAATACAGTCAGATACAGTCAG | 1640 | /5Phos/CGAACTGACTGTATCTGACTGTAT |
| 105 | ATACCGGCCTATACCGGCCT | 873 | /5Phos/CAGAATACCGGCCTATACCGGCCT | 1641 | /5Phos/CGAAAGGCCGGTATAGGCCGGTAT |
| 106 | ATAGCAGGATATAGCAGGAT | 874 | /5Phos/CAGAATAGCAGGATATAGCAGGAT | 1642 | /5Phos/CGAAATCCTGCTATATCCTGCTAT |
| 107 | ATAGCGTTACATAGCGTTAC | 875 | /5Phos/CAGAATAGCGTTACATAGCGTTAC | 1643 | /5Phos/CGAAGTAACGCTATGTAACGCTAT |
| 108 | ATAGTCCAACATAGTCCAAC | 876 | /5Phos/CAGAATAGTCCAACATAGTCCAAC | 1644 | /5Phos/CGAAGTTGGACTATGTTGGACTAT |
| 109 | ATATCGGCGGATATCGGCGG | 877 | /5Phos/CAGAATATCGGCGGATATCGGCGG | 1645 | /5Phos/CGAACCGCCGATATCCGCCGATAT |
| 110 | ATCCGTGATGATCCGTGATG | 878 | /5Phos/CAGAATCCGTGATGATCCGTGATG | 1646 | /5Phos/CGAACATCACGGATCATCACGGAT |
| 111 | ATCGTACCGGATCGTACCGG | 879 | /5Phos/CAGAATCGTACCGGATCGTACCGG | 1647 | /5Phos/CGAACCGGTACGATCCGGTACGAT |
| 112 | ATCGTTACTGATCGTTACTG | 880 | /5Phos/CAGAATCGTTACTGATCGTTACTG | 1648 | /5Phos/CGAACAGTAACGATCAGTAACGAT |
| 113 | ATGAAGATGCATGAAGATGC | 881 | /5Phos/CAGAATGAAGATGCATGAAGATGC | 1649 | /5Phos/CGAAGCATCTTCATGCATCTTCAT |
| 114 | ATGGCGTGGTATGGCGTGGT | 882 | /5Phos/CAGAATGGCGTGGTATGGCGTGGT | 1650 | /5Phos/CGAAACCACGCCATACCACGCCAT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 115 | ATGTTGAGCGATGTTGAGCG | 883 | /5Phos/CAGAATGTTGAGCGATGTTGAGCG | 1651 | /5Phos/CGAACGCTCAACATCGCTCAACAT |
| 116 | ATTAGCTGTCATTAGCTGTC | 884 | /5Phos/CAGAATTAGCTGTCATTAGCTGTC | 1652 | /5Phos/CGAAGACAGCTAATGACAGCTAAT |
| 117 | ATTCGCGTGCATTCGCGTGC | 885 | /5Phos/CAGAATTCGCGTGCATTCGCGTGC | 1653 | /5Phos/CGAAGCACGCGAATGCACGCGAAT |
| 118 | ATTGCGCTCCATTGCGCTCC | 886 | /5Phos/CAGAATTGCGCTCCATTGCGCTCC | 1654 | /5Phos/CGAAGGAGCGCAATGGAGCGCAAT |
| 119 | ATTGTGTTGCATTGTGTTGC | 887 | /5Phos/CAGAATTGTGTTGCATTGTGTTGC | 1655 | /5Phos/CGAAGCAACACAATGCAACACAAT |
| 120 | CAAGACGAATCAAGACGAAT | 888 | /5Phos/CAGACAAGACGAATCAAGACGAAT | 1656 | /5Phos/CGAAATTCGTCTTGATTCGTCTTG |
| 121 | CACGCACTGTCACGCACTGT | 889 | /5Phos/CAGACACGCACTGTCACGCACTGT | 1657 | /5Phos/CGAAACAGTGCGTGACAGTGCGTG |
| 122 | CACGGAGTAGCACGGAGTAG | 890 | /5Phos/CAGACACGGAGTAGCACGGAGTAG | 1658 | /5Phos/CGAACTACTCCGTGCTACTCCGTG |
| 123 | CACGGTATCGCACGGTATCG | 891 | /5Phos/CAGACACGGTATCGCACGGTATCG | 1659 | /5Phos/CGAACGATACCGTGCGATACCGTG |
| 124 | CACTCGGATTCACTCGGATT | 892 | /5Phos/CAGACACTCGGATTCACTCGGATT | 1660 | /5Phos/CGAAAATCCGAGTGAATCCGAGTG |
| 125 | CACTTGAGTACACTTGAGTA | 893 | /5Phos/CAGACACTTGAGTACACTTGAGTA | 1661 | /5Phos/CGAATACTCAAGTGTACTCAAGTG |
| 126 | CAGCCTCAGTCAGCCTCAGT | 894 | /5Phos/CAGACAGCCTCAGTCAGCCTCAGT | 1662 | /5Phos/CGAAACTGAGGCTGACTGAGGCTG |
| 127 | CAGCTCCAAGCAGCTCCAAG | 895 | /5Phos/CAGACAGCTCCAAGCAGCTCCAAG | 1663 | /5Phos/CGAACTTGGAGCTGCTTGGAGCTG |
| 128 | CATCGAGGAGCATCGAGGAG | 896 | /5Phos/CAGACATCGAGGAGCATCGAGGAG | 1664 | /5Phos/CGAACTCCTCGATGCTCCTCGATG |
| 129 | CATTGGCCGTCATTGGCCGT | 897 | /5Phos/CAGACATTGGCCGTCATTGGCCGT | 1665 | /5Phos/CGAAACGGCCAATGACGGCCAATG |
| 130 | CCAGAACTGGCCAGAACTGG | 898 | /5Phos/CAGACCAGAACTGGCCAGAACTGG | 1666 | /5Phos/CGAACCAGTTCTGGCCAGTTCTGG |
| 131 | CCAGATACGGCCAGATACGG | 899 | /5Phos/CAGACCAGATACGGCCAGATACGG | 1667 | /5Phos/CGAACCGTATCTGGCCGTATCTGG |
| 132 | CCAGGATCCACCAGGATCCA | 900 | /5Phos/CAGACCAGGATCCACCAGGATCCA | 1668 | /5Phos/CGAATGGATCCTGGTGGATCCTGG |
| 133 | CCAGGATGTTCCAGGATGTT | 901 | /5Phos/CAGACCAGGATGTTCCAGGATGTT | 1669 | /5Phos/CGAAAACATCCTGGAACATCCTGG |
| 134 | CCGAGCATGTCCGAGCATGT | 902 | /5Phos/CAGACCGAGCATGTCCGAGCATGT | 1670 | /5Phos/CGAAACATGCTCGGACATGCTCGG |
| 135 | CCGGAGTGTTCCGGAGTGTT | 903 | /5Phos/CAGACCGGAGTGTTCCGGAGTGTT | 1671 | /5Phos/CGAAAACACTCCGGAACACTCCGG |
| 136 | CCGGTACCATCCGGTACCAT | 904 | /5Phos/CAGACCGGTACCATCCGGTACCAT | 1672 | /5Phos/CGAAATGGTACCGGATGGTACCGG |
| 137 | CCGTCTAAGGCCGTCTAAGG | 905 | /5Phos/CAGACCGTCTAAGGCCGTCTAAGG | 1673 | /5Phos/CGAACCTTAGACGGCCTTAGACGG |
| 138 | CCTCCATTAACCTCCATTAA | 906 | /5Phos/CAGACCTCCATTAACCTCCATTAA | 1674 | /5Phos/CGAATTAATGGAGGTTAATGGAGG |
| 139 | CCTCCTGACTCCTCCTGACT | 907 | /5Phos/CAGACCTCCTGACTCCTCCTGACT | 1675 | /5Phos/CGAAAGTCAGGAGGAGTCAGGAGG |
| 140 | CCTCTGCTCTCCTCTGCTCT | 908 | /5Phos/CAGACCTCTGCTCTCCTCTGCTCT | 1676 | /5Phos/CGAAAGAGCAGAGGAGAGCAGAGG |
| 141 | CCTGCCTTGTCCTGCCTTGT | 909 | /5Phos/CAGACCTGCCTTGTCCTGCCTTGT | 1677 | /5Phos/CGAAACAAGGCAGGACAAGGCAGG |
| 142 | CCTGGCCATTCCTGGCCATT | 910 | /5Phos/CAGACCTGGCCATTCCTGGCCATT | 1678 | /5Phos/CGAAAATGGCCAGGAATGGCCAGG |
| 143 | CCTTAACGCGCCTTAACGCG | 911 | /5Phos/CAGACCTTAACGCGCCTTAACGCG | 1679 | /5Phos/CGAACGCGTTAAGGCGCGTTAAGG |
| 144 | CGACCTGTCTCGACCTGTCT | 912 | /5Phos/CAGACGACCTGTCTCGACCTGTCT | 1680 | /5Phos/CGAAAGACAGGTCGAGACAGGTCG |
| 145 | CGCGTTACGTCGCGTTACGT | 913 | /5Phos/CAGACGCGTTACGTCGCGTTACGT | 1681 | /5Phos/CGAAACGTAACGCGACGTAACGCG |
| 146 | CGGCAGTTCACGGCAGTTCA | 914 | /5Phos/CAGACGGCAGTTCACGGCAGTTCA | 1682 | /5Phos/CGAATGAACTGCCGTGAACTGCCG |
| 147 | CGGCCATTAGCGGCCATTAG | 915 | /5Phos/CAGACGGCCATTAGCGGCCATTAG | 1683 | /5Phos/CGAACTAATGGCCGCTAATGGCCG |
| 148 | CGTATTGCATCGTATTGCAT | 916 | /5Phos/CAGACGTATTGCATCGTATTGCAT | 1684 | /5Phos/CGAAATGCAATACGATGCAATACG |
| 149 | CTACGACCGTCTACGACCGT | 917 | /5Phos/CAGACTACGACCGTCTACGACCGT | 1685 | /5Phos/CGAAACGGTCGTAGACGGTCGTAG |
| 150 | CTAGGAAGGTCTAGGAAGGT | 918 | /5Phos/CAGACTAGGAAGGTCTAGGAAGGT | 1686 | /5Phos/CGAAACCTTCCTAGACCTTCCTAG |
| 151 | CTAGTCCTGTCTAGTCCTGT | 919 | /5Phos/CAGACTAGTCCTGTCTAGTCCTGT | 1687 | /5Phos/CGAAACAGGACTAGACAGGACTAG |
| 152 | CTAGTGGAGGCTAGTGGAGG | 920 | /5Phos/CAGACTAGTGGAGGCTAGTGGAGG | 1688 | /5Phos/CGAACCTCCACTAGCCTCCACTAG |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 153 | CTCGCAGAGTCTCGCAGAGT | 921 | /5Phos/CAGACTCGCAGAGTCTCGCAGAGT | 1689 | /5Phos/CGAAACTCTGCGAGACTCTGCGAG |
| 154 | CTCGCTTCGTCTCGCTTCGT | 922 | /5Phos/CAGACTCGCTTCGTCTCGCTTCGT | 1690 | /5Phos/CGAAACGAAGCGAGACGAAGCGAG |
| 155 | CTCGTTAGCGCTCGTTAGCG | 923 | /5Phos/CAGACTCGTTAGCGCTCGTTAGCG | 1691 | /5Phos/CGAACGCTAACGAGCGCTAACGAG |
| 156 | CTCTTCCAAGCTCTTCCAAG | 924 | /5Phos/CAGACTCTTCCAAGCTCTTCCAAG | 1692 | /5Phos/CGAACTTGGAAGAGCTTGGAAGAG |
| 157 | CTGCTTCAATCTGCTTCAAT | 925 | /5Phos/CAGACTGCTTCAATCTGCTTCAAT | 1693 | /5Phos/CGAAATTGAAGCAGATTGAAGCAG |
| 158 | CTGGTATCAACTGGTATCAA | 926 | /5Phos/CAGACTGGTATCAACTGGTATCAA | 1694 | /5Phos/CGAATTGATACCAGTTGATACCAG |
| 159 | CTGTCTTCGGCTGTCTTCGG | 927 | /5Phos/CAGACTGTCTTCGGCTGTCTTCGG | 1695 | /5Phos/CGAACCGAAGACAGCCGAAGACAG |
| 160 | CTTCATGACGCTTCATGACG | 928 | /5Phos/CAGACTTCATGACGCTTCATGACG | 1696 | /5Phos/CGAACGTCATGAAGCGTCATGAAG |
| 161 | CTTCGGCAGTCTTCGGCAGT | 929 | /5Phos/CAGACTTCGGCAGTCTTCGGCAGT | 1697 | /5Phos/CGAAACTGCCGAAGACTGCCGAAG |
| 162 | CTTGACCGGTCTTGACCGGT | 930 | /5Phos/CAGACTTGACCGGTCTTGACCGGT | 1698 | /5Phos/CGAAACCGGTCAAGACCGGTCAAG |
| 163 | CTTGCCTATTCTTGCCTATT | 931 | /5Phos/CAGACTTGCCTATTCTTGCCTATT | 1699 | /5Phos/CGAAAATAGGCAAGAATAGGCAAG |
| 164 | GAACTTGTGAGAACTTGTGA | 932 | /5Phos/CAGAGAACTTGTGAGAACTTGTGA | 1700 | /5Phos/CGAATCACAAGTTCTCACAAGTTC |
| 165 | GAAGCATTCTGAAGCATTCT | 933 | /5Phos/CAGAGAAGCATTCTGAAGCATTCT | 1701 | /5Phos/CGAAAGAATGCTTCAGAATGCTTC |
| 166 | GAATCCATTCGAATCCATTC | 934 | /5Phos/CAGAGAATCCATTCGAATCCATTC | 1702 | /5Phos/CGAAGAATGGATTCGAATGGATTC |
| 167 | GACGCCTGTTGACGCCTGTT | 935 | /5Phos/CAGAGACGCCTGTTGACGCCTGTT | 1703 | /5Phos/CGAAAACAGGCGTCAACAGGCGTC |
| 168 | GACGTAGGACGACGTAGGAC | 936 | /5Phos/CAGAGACGTAGGACGACGTAGGAC | 1704 | /5Phos/CGAAGTCCTACGTCGTCCTACGTC |
| 169 | GACTAATGGTGACTAATGGT | 937 | /5Phos/CAGAGACTAATGGTGACTAATGGT | 1705 | /5Phos/CGAAACCATTAGTCACCATTAGTC |
| 170 | GAGCCTCCTTGAGCCTCCTT | 938 | /5Phos/CAGAGAGCCTCCTTGAGCCTCCTT | 1706 | /5Phos/CGAAAAGGAGGCTCAAGGAGGCTC |
| 171 | GAGCGTCTACGAGCGTCTAC | 939 | /5Phos/CAGAGAGCGTCTACGAGCGTCTAC | 1707 | /5Phos/CGAAGTAGACGCTCGTAGACGCTC |
| 172 | GAGGATAGGCGAGGATAGGC | 940 | /5Phos/CAGAGAGGATAGGCGAGGATAGGC | 1708 | /5Phos/CGAAGCCTATCCTCGCCTATCCTC |
| 173 | GAGTGCCATCGAGTGCCATC | 941 | /5Phos/CAGAGAGTGCCATCGAGTGCCATC | 1709 | /5Phos/CGAAGATGGCACTCGATGGCACTC |
| 174 | GAGTGGATCTGAGTGGATCT | 942 | /5Phos/CAGAGAGTGGATCTGAGTGGATCT | 1710 | /5Phos/CGAAAGATCCACTCAGATCCACTC |
| 175 | GAGTGGTAGCGAGTGGTAGC | 943 | /5Phos/CAGAGAGTGGTAGCGAGTGGTAGC | 1711 | /5Phos/CGAAGCTACCACTCGCTACCACTC |
| 176 | GAGTTAGAGAGAGTTAGAGA | 944 | /5Phos/CAGAGAGTTAGAGAGAGTTAGAGA | 1712 | /5Phos/CGAATCTCTAACTCTCTCTAACTC |
| 177 | GCACATCTGCGCACATCTGC | 945 | /5Phos/CAGAGCACATCTGCGCACATCTGC | 1713 | /5Phos/CGAAGCAGATGTGCGCAGATGTGC |
| 178 | GCACCATTACGCACCATTAC | 946 | /5Phos/CAGAGCACCATTACGCACCATTAC | 1714 | /5Phos/CGAAGTAATGGTGCGTAATGGTGC |
| 179 | GCAGCCTATTGCAGCCTATT | 947 | /5Phos/CAGAGCAGCCTATTGCAGCCTATT | 1715 | /5Phos/CGAAAATAGGCTGCAATAGGCTGC |
| 180 | GCAGTATCAAGCAGTATCAA | 948 | /5Phos/CAGAGCAGTATCAAGCAGTATCAA | 1716 | /5Phos/CGAATTGATACTGCTTGATACTGC |
| 181 | GCCGTCGTTAGCCGTCGTTA | 949 | /5Phos/CAGAGCCGTCGTTAGCCGTCGTTA | 1717 | /5Phos/CGAATAACGACGGCTAACGACGGC |
| 182 | GCCTGAGCTAGCCTGAGCTA | 950 | /5Phos/CAGAGCCTGAGCTAGCCTGAGCTA | 1718 | /5Phos/CGAATAGCTCAGGCTAGCTCAGGC |
| 183 | GCGCAAGCAAGCGCAAGCAA | 951 | /5Phos/CAGAGCGCAAGCAAGCGCAAGCAA | 1719 | /5Phos/CGAATTGCTTGCGCTTGCTTGCGC |
| 184 | GCGTTACGACGCGTTACGAC | 952 | /5Phos/CAGAGCGTTACGACGCGTTACGAC | 1720 | /5Phos/CGAAGTCGTAACGCGTCGTAACGC |
| 185 | GCGTTGGATCGCGTTGGATC | 953 | /5Phos/CAGAGCGTTGGATCGCGTTGGATC | 1721 | /5Phos/CGAAGATCCAACGCGATCCAACGC |
| 186 | GCTAGTCGCAGCTAGTCGCA | 954 | /5Phos/CAGAGCTAGTCGCAGCTAGTCGCA | 1722 | /5Phos/CGAATGCGACTAGCTGCGACTAGC |
| 187 | GCTCACTACCGCTCACTACC | 955 | /5Phos/CAGAGCTCACTACCGCTCACTACC | 1723 | /5Phos/CGAAGGTAGTGAGCGGTAGTGAGC |
| 188 | GCTCGAATTAGCTCGAATTA | 956 | /5Phos/CAGAGCTCGAATTAGCTCGAATTA | 1724 | /5Phos/CGAATAATTCGAGCTAATTCGAGC |
| 189 | GCTCGATTCCGCTCGATTCC | 957 | /5Phos/CAGAGCTCGATTCCGCTCGATTCC | 1725 | /5Phos/CGAAGGAATCGAGCGGAATCGAGC |
| 190 | GCTGAGGATCGCTGAGGATC | 958 | /5Phos/CAGAGCTGAGGATCGCTGAGGATC | 1726 | /5Phos/CGAAGATCCTCAGCGATCCTCAGC |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 191 | GCTTCATTCTGCTTCATTCT | 959 | /5Phos/CAGAGCTTCATTCTGCTTCATTCT | 1727 | /5Phos/CGAAAGAATGAAGCAGAATGAAGC |
| 192 | GCTTGCTATTGCTTGCTATT | 960 | /5Phos/CAGAGCTTGCTATTGCTTGCTATT | 1728 | /5Phos/CGAAAATAGCAAGCAATAGCAAGC |
| 193 | GCTTGGTTGCGCTTGGTTGC | 961 | /5Phos/TTCGGCTTGGTTGCGCTTGGTTGC | 1729 | /5Phos/GTCAGCAACCAAGCGCAACCAAGC |
| 194 | GGAGTGGTTCGGAGTGGTTC | 962 | /5Phos/TTCGGGAGTGGTTCGGAGTGGTTC | 1730 | /5Phos/GTCAGAACCACTCCGAACCACTCC |
| 195 | GGATAATACCGGATAATACC | 963 | /5Phos/TTCGGGATAATACCGGATAATACC | 1731 | /5Phos/GTCAGGTATTATCCGGTATTATCC |
| 196 | GGATCGTGGTGGATCGTGGT | 964 | /5Phos/TTCGGGATCGTGGTGGATCGTGGT | 1732 | /5Phos/GTCAACCACGATCCACCACGATCC |
| 197 | GGATGATTGTGGATGATTGT | 965 | /5Phos/TTCGGGATGATTGTGGATGATTGT | 1733 | /5Phos/GTCAACAATCATCCACAATCATCC |
| 198 | GGATGCGTTCGGATGCGTTC | 966 | /5Phos/TTCGGGATGCGTTCGGATGCGTTC | 1734 | /5Phos/GTCAGAACGCATCCGAACGCATCC |
| 199 | GGCGAATGTCGGCGAATGTC | 967 | /5Phos/TTCGGGCGAATGTCGGCGAATGTC | 1735 | /5Phos/GTCAGACATTCGCCGACATTCGCC |
| 200 | GGCGATTGGTGGCGATTGGT | 968 | /5Phos/TTCGGGCGATTGGTGGCGATTGGT | 1736 | /5Phos/GTCAACCAATCGCCACCAATCGCC |
| 201 | GGCGGTATCAGGCGGTATCA | 969 | /5Phos/TTCGGGCGGTATCAGGCGGTATCA | 1737 | /5Phos/GTCATGATACCGCCTGATACCGCC |
| 202 | GGCTATCCACGGCTATCCAC | 970 | /5Phos/TTCGGGCTATCCACGGCTATCCAC | 1738 | /5Phos/GTCAGTGGATAGCCGTGGATAGCC |
| 203 | GGCTATTACAGGCTATTACA | 971 | /5Phos/TTCGGGCTATTACAGGCTATTACA | 1739 | /5Phos/GTCATGTAATAGCCTGTAATAGCC |
| 204 | GGCTGAACTCGGCTGAACTC | 972 | /5Phos/TTCGGGCTGAACTCGGCTGAACTC | 1740 | /5Phos/GTCAGAGTTCAGCCGAGTTCAGCC |
| 205 | GGTACAGTCAGGTACAGTCA | 973 | /5Phos/TTCGGGTACAGTCAGGTACAGTCA | 1741 | /5Phos/GTCATGACTGTACCTGACTGTACC |
| 206 | GGTCGAACCTGGTCGAACCT | 974 | /5Phos/TTCGGGTCGAACCTGGTCGAACCT | 1742 | /5Phos/GTCAAGGTTCGACCAGGTTCGACC |
| 207 | GGTCTCTCGTGGTCTCTCGT | 975 | /5Phos/TTCGGGTCTCTCGTGGTCTCTCGT | 1743 | /5Phos/GTCAACGAGAGACCACGAGAGACC |
| 208 | GGTGCTTGTCGGTGCTTGTC | 976 | /5Phos/TTCGGGTGCTTGTCGGTGCTTGTC | 1744 | /5Phos/GTCAGACAAGCACCGACAAGCACC |
| 209 | GGTTCCACTTGGTTCCACTT | 977 | /5Phos/TTCGGGTTCCACTTGGTTCCACTT | 1745 | /5Phos/GTCAAAGTGGAACCAAGTGGAACC |
| 210 | GGTTGCATCCGGTTGCATCC | 978 | /5Phos/TTCGGGTTGCATCCGGTTGCATCC | 1746 | /5Phos/GTCAGGATGCAACCGGATGCAACC |
| 211 | GGTTGGACGTGGTTGGACGT | 979 | /5Phos/TTCGGGTTGGACGTGGTTGGACGT | 1747 | /5Phos/GTCAACGTCCAACCACGTCCAACC |
| 212 | GTAAGAGCAAGTAAGAGCAA | 980 | /5Phos/TTCGGTAAGAGCAAGTAAGAGCAA | 1748 | /5Phos/GTCATTGCTCTTACTTGCTCTTAC |
| 213 | GTAAGGCTTAGTAAGGCTTA | 981 | /5Phos/TTCGGTAAGGCTTAGTAAGGCTTA | 1749 | /5Phos/GTCATAAGCCTTACTAAGCCTTAC |
| 214 | GTAGTCCTCAGTAGTCCTCA | 982 | /5Phos/TTCGGTAGTCCTCAGTAGTCCTCA | 1750 | /5Phos/GTCATGAGGACTACTGAGGACTAC |
| 215 | GTCCGGTTCTGTCCGGTTCT | 983 | /5Phos/TTCGGTCCGGTTCTGTCCGGTTCT | 1751 | /5Phos/GTCAAGAACCGGACAGAACCGGAC |
| 216 | GTCCTACAGCGTCCTACAGC | 984 | /5Phos/TTCGGTCCTACAGCGTCCTACAGC | 1752 | /5Phos/GTCAGCTGTAGGACGCTGTAGGAC |
| 217 | GTCGGATTAAGTCGGATTAA | 985 | /5Phos/TTCGGTCGGATTAAGTCGGATTAA | 1753 | /5Phos/GTCATTAATCCGACTTAATCCGAC |
| 218 | GTGAACAGAAGTGAACAGAA | 986 | /5Phos/TTCGGTGAACAGAAGTGAACAGAA | 1754 | /5Phos/GTCATTCTGTTCACTTCTGTTCAC |
| 219 | GTGCCTACACGTGCCTACAC | 987 | /5Phos/TTCGGTGCCTACACGTGCCTACAC | 1755 | /5Phos/GTCAGTGTAGGCACGTGTAGGCAC |
| 220 | GTGTATCGGAGTGTATCGGA | 988 | /5Phos/TTCGGTGTATCGGAGTGTATCGGA | 1756 | /5Phos/GTCATCCGATACACTCCGATACAC |
| 221 | GTGTCCATGAGTGTCCATGA | 989 | /5Phos/TTCGGTGTCCATGAGTGTCCATGA | 1757 | /5Phos/GTCATCATGGACACTCATGGACAC |
| 222 | GTGTCTAATCGTGTCTAATC | 990 | /5Phos/TTCGGTGTCTAATCGTGTCTAATC | 1758 | /5Phos/GTCAGATTAGACACGATTAGACAC |
| 223 | GTGTTCCTGCGTGTTCCTGC | 991 | /5Phos/TTCGGTGTTCCTGCGTGTTCCTGC | 1759 | /5Phos/GTCAGCAGGAACACGCAGGAACAC |
| 224 | GTGTTCTGCTGTGTTCTGCT | 992 | /5Phos/TTCGGTGTTCTGCTGTGTTCTGCT | 1760 | /5Phos/GTCAAGCAGAACACAGCAGAACAC |
| 225 | GTTAAGAGGAGTTAAGAGGA | 993 | /5Phos/TTCGGTTAAGAGGAGTTAAGAGGA | 1761 | /5Phos/GTCATCCTCTTAACTCCTCTTAAC |
| 226 | GTTAATGCGTGTTAATGCGT | 994 | /5Phos/TTCGGTTAATGCGTGTTAATGCGT | 1762 | /5Phos/GTCAACGCATTAACACGCATTAAC |
| 227 | GTTAGGCTGTGTTAGGCTGT | 995 | /5Phos/TTCGGTTAGGCTGTGTTAGGCTGT | 1763 | /5Phos/GTCAACAGCCTAACACAGCCTAAC |
| 228 | GTTCATTGGAGTTCATTGGA | 996 | /5Phos/TTCGGTTCATTGGAGTTCATTGGA | 1764 | /5Phos/GTCATCCAATGAACTCCAATGAAC |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 229 | GTTCGGACCAGTTCGGACCA | 997 | /5Phos/TTCGGTTCGGACCAGTTCGGACCA | 1765 | /5Phos/GTCATGGTCCGAACTGGTCCGAAC |
| 230 | GTTGGCCAGTGTTGGCCAGT | 998 | /5Phos/TTCGGTTGGCCAGTGTTGGCCAGT | 1766 | /5Phos/GTCAACTGGCCAACACTGGCCAAC |
| 231 | GTTGGTAGTTGTTGGTAGTT | 999 | /5Phos/TTCGGTTGGTAGTTGTTGGTAGTT | 1767 | /5Phos/GTCAAACTACCAACAACTACCAAC |
| 232 | TAACACGACATAACACGACA | 1000 | /5Phos/TTCGTAACACGACATAACACGACA | 1768 | /5Phos/GTCATGTCGTGTTATGTCGTGTTA |
| 233 | TAAGAGAGCATAAGAGAGCA | 1001 | /5Phos/TTCGTAAGAGAGCATAAGAGAGCA | 1769 | /5Phos/GTCATGCTCTCTTATGCTCTCTTA |
| 234 | TAAGAGGCGGTAAGAGGCGG | 1002 | /5Phos/TTCGTAAGAGGCGGTAAGAGGCGG | 1770 | /5Phos/GTCACCGCCTCTTACCGCCTCTTA |
| 235 | TAAGGAATGGTAAGGAATGG | 1003 | /5Phos/TTCGTAAGGAATGGTAAGGAATGG | 1771 | /5Phos/GTCACCATTCCTTACCATTCCTTA |
| 236 | TAATGAGCACTAATGAGCAC | 1004 | /5Phos/TTCGTAATGAGCACTAATGAGCAC | 1772 | /5Phos/GTCAGTGCTCATTAGTGCTCATTA |
| 237 | TACACTGGTCTACACTGGTC | 1005 | /5Phos/TTCGTACACTGGTCTACACTGGTC | 1773 | /5Phos/GTCAGACCAGTGTAGACCAGTGTA |
| 238 | TACAGCGCAATACAGCGCAA | 1006 | /5Phos/TTCGTACAGCGCAATACAGCGCAA | 1774 | /5Phos/GTCATTGCGCTGTATTGCGCTGTA |
| 239 | TACAGGTTAGTACAGGTTAG | 1007 | /5Phos/TTCGTACAGGTTAGTACAGGTTAG | 1775 | /5Phos/GTCACTAACCTGTACTAACCTGTA |
| 240 | TACATTACCGTACATTACCG | 1008 | /5Phos/TTCGTACATTACCGTACATTACCG | 1776 | /5Phos/GTCACGGTAATGTACGGTAATGTA |
| 241 | TACCAATCTCTACCAATCTC | 1009 | /5Phos/TTCGTACCAATCTCTACCAATCTC | 1777 | /5Phos/GTCAGAGATTGGTAGAGATTGGTA |
| 242 | TACCGGAGAGTACCGGAGAG | 1010 | /5Phos/TTCGTACCGGAGAGTACCGGAGAG | 1778 | /5Phos/GTCACTCTCCGGTACTCTCCGGTA |
| 243 | TACCGGCTTCTACCGGCTTC | 1011 | /5Phos/TTCGTACCGGCTTCTACCGGCTTC | 1779 | /5Phos/GTCAGAAGCCGGTAGAAGCCGGTA |
| 244 | TACCTACATGTACCTACATG | 1012 | /5Phos/TTCGTACCTACATGTACCTACATG | 1780 | /5Phos/GTCACATGTAGGTACATGTAGGTA |
| 245 | TACGATTACGTACGATTACG | 1013 | /5Phos/TTCGTACGATTACGTACGATTACG | 1781 | /5Phos/GTCACGTAATCGTACGTAATCGTA |
| 246 | TACGCAGAGGTACGCAGAGG | 1014 | /5Phos/TTCGTACGCAGAGGTACGCAGAGG | 1782 | /5Phos/GTCACCTCTGCGTACCTCTGCGTA |
| 247 | TACTCAACGATACTCAACGA | 1015 | /5Phos/TTCGTACTCAACGATACTCAACGA | 1783 | /5Phos/GTCATCGTTGAGTATCGTTGAGTA |
| 248 | TAGACCAACCTAGACCAACC | 1016 | /5Phos/TTCGTAGACCAACCTAGACCAACC | 1784 | /5Phos/GTCAGGTTGGTCTAGGTTGGTCTA |
| 249 | TAGACCTCCGTAGACCTCCG | 1017 | /5Phos/TTCGTAGACCTCCGTAGACCTCCG | 1785 | /5Phos/GTCACGGAGGTCTACGGAGGTCTA |
| 250 | TAGCAGTTGATAGCAGTTGA | 1018 | /5Phos/TTCGTAGCAGTTGATAGCAGTTGA | 1786 | /5Phos/GTCATCAACTGCTATCAACTGCTA |
| 251 | TAGCGCAAGCTAGCGCAAGC | 1019 | /5Phos/TTCGTAGCGCAAGCTAGCGCAAGC | 1787 | /5Phos/GTCAGCTTGCGCTAGCTTGCGCTA |
| 252 | TAGCTATACCTAGCTATACC | 1020 | /5Phos/TTCGTAGCTATACCTAGCTATACC | 1788 | /5Phos/GTCAGGTATAGCTAGGTATAGCTA |
| 253 | TAGCTTGCGCTAGCTTGCGC | 1021 | /5Phos/TTCGTAGCTTGCGCTAGCTTGCGC | 1789 | /5Phos/GTCAGCGCAAGCTAGCGCAAGCTA |
| 254 | TAGGAATCCATAGGAATCCA | 1022 | /5Phos/TTCGTAGGAATCCATAGGAATCCA | 1790 | /5Phos/GTCATGGATTCCTATGGATTCCTA |
| 255 | TAGGCCGTTCTAGGCCGTTC | 1023 | /5Phos/TTCGTAGGCCGTTCTAGGCCGTTC | 1791 | /5Phos/GTCAGAACGGCCTAGAACGGCCTA |
| 256 | TAGGTCACTATAGGTCACTA | 1024 | /5Phos/TTCGTAGGTCACTATAGGTCACTA | 1792 | /5Phos/GTCATAGTGACCTATAGTGACCTA |
| 257 | TAGTCGCGTCTAGTCGCGTC | 1025 | /5Phos/TTCGTAGTCGCGTCTAGTCGCGTC | 1793 | /5Phos/GTCAGACGCGACTAGACGCGACTA |
| 258 | TATACGGCTATATACGGCTA | 1026 | /5Phos/TTCGTATACGGCTATATACGGCTA | 1794 | /5Phos/GTCATAGCCGTATATAGCCGTATA |
| 259 | TATCGCGGCATATCGCGGCA | 1027 | /5Phos/TTCGTATCGCGGCATATCGCGGCA | 1795 | /5Phos/GTCATGCCGCGATATGCCGCGATA |
| 260 | TATGGAGCAATATGGAGCAA | 1028 | /5Phos/TTCGTATGGAGCAATATGGAGCAA | 1796 | /5Phos/GTCATTGCTCCATATTGCTCCATA |
| 261 | TATGGCGTGGTATGGCGTGG | 1029 | /5Phos/TTCGTATGGCGTGGTATGGCGTGG | 1797 | /5Phos/GTCACCACGCCATACCACGCCATA |
| 262 | TATGTTCAGGTATGTTCAGG | 1030 | /5Phos/TTCGTATGTTCAGGTATGTTCAGG | 1798 | /5Phos/GTCACCTGAACATACCTGAACATA |
| 263 | TATTCCTGTCTATTCCTGTC | 1031 | /5Phos/TTCGTATTCCTGTCTATTCCTGTC | 1799 | /5Phos/GTCAGACAGGAATAGACAGGAATA |
| 264 | TCAAGAGATCTCAAGAGATC | 1032 | /5Phos/TTCGTCAAGAGATCTCAAGAGATC | 1800 | /5Phos/GTCAGATCTCTTGAGATCTCTTGA |
| 265 | TCACTACCAATCACTACCAA | 1033 | /5Phos/TTCGTCACTACCAATCACTACCAA | 1801 | /5Phos/GTCATTGGTAGTGATTGGTAGTGA |
| 266 | TCAGTCTGCGTCAGTCTGCG | 1034 | /5Phos/TTCGTCAGTCTGCGTCAGTCTGCG | 1802 | /5Phos/GTCACGCAGACTGACGCAGACTGA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 267 | TCAGTTAAGCTCAGTTAAGC | 1035 | /5Phos/TTCGTCAGTTAAGCTCAGTTAAGC | 1803 | /5Phos/GTCAGCTTAACTGAGCTTAACTGA |
| 268 | TCCAGAGTGGTCCAGAGTGG | 1036 | /5Phos/TTCGTCCAGAGTGGTCCAGAGTGG | 1804 | /5Phos/GTCACCACTCTGGACCACTCTGGA |
| 269 | TCCAGTCGTCTCCAGTCGTC | 1037 | /5Phos/TTCGTCCAGTCGTCTCCAGTCGTC | 1805 | /5Phos/GTCAGACGACTGGAGACGACTGGA |
| 270 | TCCGACGTTGTCCGACGTTG | 1038 | /5Phos/TTCGTCCGACGTTGTCCGACGTTG | 1806 | /5Phos/GTCACAACGTCGGACAACGTCGGA |
| 271 | TCCTACCGACTCCTACCGAC | 1039 | /5Phos/TTCGTCCTACCGACTCCTACCGAC | 1807 | /5Phos/GTCAGTCGGTAGGAGTCGGTAGGA |
| 272 | TCCTTCCTCCTCCTTCCTCC | 1040 | /5Phos/TTCGTCCTTCCTCCTCCTTCCTCC | 1808 | /5Phos/GTCAGGAGGAAGGAGGAGGAAGGA |
| 273 | TCGAGAGCCATCGAGAGCCA | 1041 | /5Phos/TTCGTCGAGAGCCATCGAGAGCCA | 1809 | /5Phos/GTCATGGCTCTCGATGGCTCTCGA |
| 274 | TCGCACAGACTCGCACAGAC | 1042 | /5Phos/TTCGTCGCACAGACTCGCACAGAC | 1810 | /5Phos/GTCAGTCTGTGCGAGTCTGTGCGA |
| 275 | TCGCCGTTAGTCGCCGTTAG | 1043 | /5Phos/TTCGTCGCCGTTAGTCGCCGTTAG | 1811 | /5Phos/GTCACTAACGGCGACTAACGGCGA |
| 276 | TCGGCACAACTCGGCACAAC | 1044 | /5Phos/TTCGTCGGCACAACTCGGCACAAC | 1812 | /5Phos/GTCAGTTGTGCCGAGTTGTGCCGA |
| 277 | TCGGCAGTTGTCGGCAGTTG | 1045 | /5Phos/TTCGTCGGCAGTTGTCGGCAGTTG | 1813 | /5Phos/GTCACAACTGCCGACAACTGCCGA |
| 278 | TCGGTCACACTCGGTCACAC | 1046 | /5Phos/TTCGTCGGTCACACTCGGTCACAC | 1814 | /5Phos/GTCAGTGTGACCGAGTGTGACCGA |
| 279 | TCGTGCTAGCTCGTGCTAGC | 1047 | /5Phos/TTCGTCGTGCTAGCTCGTGCTAGC | 1815 | /5Phos/GTCAGCTAGCACGAGCTAGCACGA |
| 280 | TCTAGCCTAATCTAGCCTAA | 1048 | /5Phos/TTCGTCTAGCCTAATCTAGCCTAA | 1816 | /5Phos/GTCATTAGGCTAGATTAGGCTAGA |
| 281 | TCTCACTGCGTCTCACTGCG | 1049 | /5Phos/TTCGTCTCACTGCGTCTCACTGCG | 1817 | /5Phos/GTCACGCAGTGAGACGCAGTGAGA |
| 282 | TCTCCGGCAATCTCCGGCAA | 1050 | /5Phos/TTCGTCTCCGGCAATCTCCGGCAA | 1818 | /5Phos/GTCATTGCCGGAGATTGCCGGAGA |
| 283 | TCTCGCTCTCTCTCGCTCTC | 1051 | /5Phos/TTCGTCTCGCTCTCTCTCGCTCTC | 1819 | /5Phos/GTCAGAGAGCGAGAGAGAGCGAGA |
| 284 | TCTGTCGCAATCTGTCGCAA | 1052 | /5Phos/TTCGTCTGTCGCAATCTGTCGCAA | 1820 | /5Phos/GTCATTGCGACAGATTGCGACAGA |
| 285 | TCTTAACCTCTCTTAACCTC | 1053 | /5Phos/TTCGTCTTAACCTCTCTTAACCTC | 1821 | /5Phos/GTCAGAGGTTAAGAGAGGTTAAGA |
| 286 | TGACACATGATGACACATGA | 1054 | /5Phos/TTCGTGACACATGATGACACATGA | 1822 | /5Phos/GTCATCATGTGTCATCATGTGTCA |
| 287 | TGAGAGTGAATGAGAGTGAA | 1055 | /5Phos/TTCGTGAGAGTGAATGAGAGTGAA | 1823 | /5Phos/GTCATTCACTCTCATTCACTCTCA |
| 288 | TGAGTGGCTGTGAGTGGCTG | 1056 | /5Phos/TTCGTGAGTGGCTGTGAGTGGCTG | 1824 | /5Phos/GTCACAGCCACTCACAGCCACTCA |
| 289 | TGATTGACCATGATTGACCA | 1057 | /5Phos/TTCGTGATTGACCATGATTGACCA | 1825 | /5Phos/GTCATGGTCAATCATGGTCAATCA |
| 290 | TGCAGTCGCATGCAGTCGCA | 1058 | /5Phos/TTCGTGCAGTCGCATGCAGTCGCA | 1826 | /5Phos/GTCATGCGACTGCATGCGACTGCA |
| 291 | TGCCATGAGGTGCCATGAGG | 1059 | /5Phos/TTCGTGCCATGAGGTGCCATGAGG | 1827 | /5Phos/GTCACCTCATGGCACCTCATGGCA |
| 292 | TGCCTAACGCTGCCTAACGC | 1060 | /5Phos/TTCGTGCCTAACGCTGCCTAACGC | 1828 | /5Phos/GTCAGCGTTAGGCAGCGTTAGGCA |
| 293 | TGCCTATAACTGCCTATAAC | 1061 | /5Phos/TTCGTGCCTATAACTGCCTATAAC | 1829 | /5Phos/GTCAGTTATAGGCAGTTATAGGCA |
| 294 | TGCGAGAGAGTGCGAGAGAG | 1062 | /5Phos/TTCGTGCGAGAGAGTGCGAGAGAG | 1830 | /5Phos/GTCACTCTCTCGCACTCTCTCGCA |
| 295 | TGCGCGATCATGCGCGATCA | 1063 | /5Phos/TTCGTGCGCGATCATGCGCGATCA | 1831 | /5Phos/GTCATGATCGCGCATGATCGCGCA |
| 296 | TGCGGAGTGATGCGGAGTGA | 1064 | /5Phos/TTCGTGCGGAGTGATGCGGAGTGA | 1832 | /5Phos/GTCATCACTCCGCATCACTCCGCA |
| 297 | TGCGGATTCCTGCGGATTCC | 1065 | /5Phos/TTCGTGCGGATTCCTGCGGATTCC | 1833 | /5Phos/GTCAGGAATCCGCAGGAATCCGCA |
| 298 | TGCGGCTACATGCGGCTACA | 1066 | /5Phos/TTCGTGCGGCTACATGCGGCTACA | 1834 | /5Phos/GTCATGTAGCCGCATGTAGCCGCA |
| 299 | TGCGTAACAATGCGTAACAA | 1067 | /5Phos/TTCGTGCGTAACAATGCGTAACAA | 1835 | /5Phos/GTCATTGTTACGCATTGTTACGCA |
| 300 | TGCGTCCTCATGCGTCCTCA | 1068 | /5Phos/TTCGTGCGTCCTCATGCGTCCTCA | 1836 | /5Phos/GTCATGAGGACGCATGAGGACGCA |
| 301 | TGCGTTCAGCTGCGTTCAGC | 1069 | /5Phos/TTCGTGCGTTCAGCTGCGTTCAGC | 1837 | /5Phos/GTCAGCTGAACGCAGCTGAACGCA |
| 302 | TGCTTCAGCGTGCTTCAGCG | 1070 | /5Phos/TTCGTGCTTCAGCGTGCTTCAGCG | 1838 | /5Phos/GTCACGCTGAAGCACGCTGAAGCA |
| 303 | TGCTTGCCTCTGCTTGCCTC | 1071 | /5Phos/TTCGTGCTTGCCTCTGCTTGCCTC | 1839 | /5Phos/GTCAGAGGCAAGCAGAGGCAAGCA |
| 204 | TGGAACTGGCTGGAACTGGC | 1072 | /5Phos/TTCGTGGAACTGGCTGGAACTGGC | 1840 | /5Phos/GTCAGCCAGTTCCAGCCAGTTCCA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 305 | TGTATTGGAGTGTATTGGAG | 1073 | /5Phos/TTCGTGTATTGGAGTGTATTGGAG | 1841 | /5Phos/GTCACTCCAATACACTCCAATACA |
| 306 | TGTGGAACGGTGTGGAACGG | 1074 | /5Phos/TTCGTGTGGAACGGTGTGGAACGG | 1842 | /5Phos/GTCACCGTTCCACACCGTTCCACA |
| 307 | TGTGGAGTCGTGTGGAGTCG | 1075 | /5Phos/TTCGTGTGGAGTCGTGTGGAGTCG | 1843 | /5Phos/GTCACGACTCCACACGACTCCACA |
| 308 | TGTGTGGCCATGTGTGGCCA | 1076 | /5Phos/TTCGTGTGTGGCCATGTGTGGCCA | 1844 | /5Phos/GTCATGGCCACACATGGCCACACA |
| 309 | TGTTAAGAGGTGTTAAGAGG | 1077 | /5Phos/TTCGTGTTAAGAGGTGTTAAGAGG | 1845 | /5Phos/GTCACCTCTTAACACCTCTTAACA |
| 310 | TGTTACTCACTGTTACTCAC | 1078 | /5Phos/TTCGTGTTACTCACTGTTACTCAC | 1846 | /5Phos/GTCAGTGAGTAACAGTGAGTAACA |
| 311 | TGTTCGCAGCTGTTCGCAGC | 1079 | /5Phos/TTCGTGTTCGCAGCTGTTCGCAGC | 1847 | /5Phos/GTCAGCTGCGAACAGCTGCGAACA |
| 312 | TGTTGGCATATGTTGGCATA | 1080 | /5Phos/TTCGTGTTGGCATATGTTGGCATA | 1848 | /5Phos/GTCATATGCCAACATATGCCAACA |
| 313 | TTAAGTGCAGTTAAGTGCAG | 1081 | /5Phos/TTCGTTAAGTGCAGTTAAGTGCAG | 1849 | /5Phos/GTCACTGCACTTAACTGCACTTAA |
| 314 | TTAGAGATCCTTAGAGATCC | 1082 | /5Phos/TTCGTTAGAGATCCTTAGAGATCC | 1850 | /5Phos/GTCAGGATCTCTAAGGATCTCTAA |
| 315 | TTAGGTCAGATTAGGTCAGA | 1083 | /5Phos/TTCGTTAGGTCAGATTAGGTCAGA | 1851 | /5Phos/GTCATCTGACCTAATCTGACCTAA |
| 316 | TTATCTCCTGTTATCTCCTG | 1084 | /5Phos/TTCGTTATCTCCTGTTATCTCCTG | 1852 | /5Phos/GTCACAGGAGATAACAGGAGATAA |
| 317 | TTCAGTGTCGTTCAGTGTCG | 1085 | /5Phos/TTCGTTCAGTGTCGTTCAGTGTCG | 1853 | /5Phos/GTCACGACACTGAACGACACTGAA |
| 318 | TTCCAAGAAGTTCCAAGAAG | 1086 | /5Phos/TTCGTTCCAAGAAGTTCCAAGAAG | 1854 | /5Phos/GTCACTTCTTGGAACTTCTTGGAA |
| 319 | TTCCACCGCATTCCACCGCA | 1087 | /5Phos/TTCGTTCCACCGCATTCCACCGCA | 1855 | /5Phos/GTCATGCGGTGGAATGCGGTGGAA |
| 320 | TTCCACTATCTTCCACTATC | 1088 | /5Phos/TTCGTTCCACTATCTTCCACTATC | 1856 | /5Phos/GTCAGATAGTGGAAGATAGTGGAA |
| 321 | TTCCACTTGATTCCACTTGA | 1089 | /5Phos/TTCGTTCCACTTGATTCCACTTGA | 1857 | /5Phos/GTCATCAAGTGGAATCAAGTGGAA |
| 322 | TTCCGAGAGCTTCCGAGAGC | 1090 | /5Phos/TTCGTTCCGAGAGCTTCCGAGAGC | 1858 | /5Phos/GTCAGCTCTCGGAAGCTCTCGGAA |
| 323 | TTCCTGAGCCTTCCTGAGCC | 1091 | /5Phos/TTCGTTCCTGAGCCTTCCTGAGCC | 1859 | /5Phos/GTCAGGCTCAGGAAGGCTCAGGAA |
| 324 | TTCGAGTCGCTTCGAGTCGC | 1092 | /5Phos/TTCGTTCGAGTCGCTTCGAGTCGC | 1860 | /5Phos/GTCAGCGACTCGAAGCGACTCGAA |
| 325 | TTCGTGCCAGTTCGTGCCAG | 1093 | /5Phos/TTCGTTCGTGCCAGTTCGTGCCAG | 1861 | /5Phos/GTCACTGGCACGAACTGGCACGAA |
| 326 | TTCTACACCATTCTACACCA | 1094 | /5Phos/TTCGTTCTACACCATTCTACACCA | 1862 | /5Phos/GTCATGGTGTAGAATGGTGTAGAA |
| 327 | TTCTCGCTCCTTCTCGCTCC | 1095 | /5Phos/TTCGTTCTCGCTCCTTCTCGCTCC | 1863 | /5Phos/GTCAGGAGCGAGAAGGAGCGAGAA |
| 328 | TTCTGGCCACTTCTGGCCAC | 1096 | /5Phos/TTCGTTCTGGCCACTTCTGGCCAC | 1864 | /5Phos/GTCAGTGGCCAGAAGTGGCCAGAA |
| 329 | TTGAATGGTGTTGAATGGTG | 1097 | /5Phos/TTCGTTGAATGGTGTTGAATGGTG | 1865 | /5Phos/GTCACACCATTCAACACCATTCAA |
| 330 | TTGAGCCGACTTGAGCCGAC | 1098 | /5Phos/TTCGTTGAGCCGACTTGAGCCGAC | 1866 | /5Phos/GTCAGTCGGCTCAAGTCGGCTCAA |
| 331 | TTGCGCCAAGTTGCGCCAAG | 1099 | /5Phos/TTCGTTGCGCCAAGTTGCGCCAAG | 1867 | /5Phos/GTCACTTGGCGCAACTTGGCGCAA |
| 332 | TTGCTCTTAGTTGCTCTTAG | 1100 | /5Phos/TTCGTTGCTCTTAGTTGCTCTTAG | 1868 | /5Phos/GTCACTAAGAGCAACTAAGAGCAA |
| 333 | TTGGCAAGGCTTGGCAAGGC | 1101 | /5Phos/TTCGTTGGCAAGGCTTGGCAAGGC | 1869 | /5Phos/GTCAGCCTTGCCAAGCCTTGCCAA |
| 334 | TTGGCTCACGTTGGCTCACG | 1102 | /5Phos/TTCGTTGGCTCACGTTGGCTCACG | 1870 | /5Phos/GTCACGTGAGCCAACGTGAGCCAA |
| 335 | TTGGCTTCCATTGGCTTCCA | 1103 | /5Phos/TTCGTTGGCTTCCATTGGCTTCCA | 1871 | /5Phos/GTCATGGAAGCCAATGGAAGCCAA |
| 336 | TTGTGGATACTTGTGGATAC | 1104 | /5Phos/TTCGTTGTGGATACTTGTGGATAC | 1872 | /5Phos/GTCAGTATCCACAAGTATCCACAA |
| 337 | AACACGGATGAACACGGATG | 1105 | /5Phos/TTCGAACACGGATGAACACGGATG | 1873 | /5Phos/GTCACATCCGTGTTCATCCGTGTT |
| 338 | AACAGACCGGAACAGACCGG | 1106 | /5Phos/TTCGAACAGACCGGAACAGACCGG | 1874 | /5Phos/GTCACCGGTCTGTTCCGGTCTGTT |
| 339 | AACAGTGATCAACAGTGATC | 1107 | /5Phos/TTCGAACAGTGATCAACAGTGATC | 1875 | /5Phos/GTCAGATCACTGTTGATCACTGTT |
| 340 | AACCATCTTGAACCATCTTG | 1108 | /5Phos/TTCGAACCATCTTGAACCATCTTG | 1876 | /5Phos/GTCACAAGATGGTTCAAGATGGTT |
| 341 | AACGGTGACGAACGGTGACG | 1109 | /5Phos/TTCGAACGGTGACGAACGGTGACG | 1877 | /5Phos/GTCACGTCACCGTTCGTCACCGTT |
| 342 | AACTACGCGGAACTACGCGG | 1110 | /5Phos/TTCGAACTACGCGGAACTACGCGG | 1878 | /5Phos/GTCACCGCGTAGTTCCGCGTAGTT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 343 | AACTAGGCTTAACTAGGCTT | 1111 | /5Phos/TTCGAACTAGGCTTAACTAGGCTT | 1879 | /5Phos/GTCAAAGCCTAGTTAAGCCTAGTT |
| 344 | AACTGGCGTGAACTGGCGTG | 1112 | /5Phos/TTCGAACTGGCGTGAACTGGCGTG | 1880 | /5Phos/GTCACACGCCAGTTCACGCCAGTT |
| 345 | AAGACAGGATAAGACAGGAT | 1113 | /5Phos/TTCGAAGACAGGATAAGACAGGAT | 1881 | /5Phos/GTCAATCCTGTCTTATCCTGTCTT |
| 346 | AAGAGCCAGTAAGAGCCAGT | 1114 | /5Phos/TTCGAAGAGCCAGTAAGAGCCAGT | 1882 | /5Phos/GTCAACTGGCTCTTACTGGCTCTT |
| 347 | AAGAGTATCGAAGAGTATCG | 1115 | /5Phos/TTCGAAGAGTATCGAAGAGTATCG | 1883 | /5Phos/GTCACGATACTCTTCGATACTCTT |
| 348 | AAGGAACACTAAGGAACACT | 1116 | /5Phos/TTCGAAGGAACACTAAGGAACACT | 1884 | /5Phos/GTCAAGTGTTCCTTAGTGTTCCTT |
| 349 | AAGTCGCAGGAAGTCGCAGG | 1117 | /5Phos/TTCGAAGTCGCAGGAAGTCGCAGG | 1885 | /5Phos/GTCACCTGCGACTTCCTGCGACTT |
| 350 | AATCACAGTCAATCACAGTC | 1118 | /5Phos/TTCGAATCACAGTCAATCACAGTC | 1886 | /5Phos/GTCAGACTGTGATTGACTGTGATT |
| 351 | AATCGCCATTAATCGCCATT | 1119 | /5Phos/TTCGAATCGCCATTAATCGCCATT | 1887 | /5Phos/GTCAAATGGCGATTAATGGCGATT |
| 352 | AATTGCGGCCAATTGCGGCC | 1120 | /5Phos/TTCGAATTGCGGCCAATTGCGGCC | 1888 | /5Phos/GTCAGGCCGCAATTGGCCGCAATT |
| 353 | ACAACTCGCGACAACTCGCG | 1121 | /5Phos/TTCGACAACTCGCGACAACTCGCG | 1889 | /5Phos/GTCACGCGAGTTGTCGCGAGTTGT |
| 354 | ACAAGCTGCGACAAGCTGCG | 1122 | /5Phos/TTCGACAAGCTGCGACAAGCTGCG | 1890 | /5Phos/GTCACGCAGCTTGTCGCAGCTTGT |
| 355 | ACACCAATTCACACCAATTC | 1123 | /5Phos/TTCGACACCAATTCACACCAATTC | 1891 | /5Phos/GTCAGAATTGGTGTGAATTGGTGT |
| 356 | ACACGAAGGTACACGAAGGT | 1124 | /5Phos/TTCGACACGAAGGTACACGAAGGT | 1892 | /5Phos/GTCAACCTTCGTGTACCTTCGTGT |
| 357 | ACAGAATGTGACAGAATGTG | 1125 | /5Phos/TTCGACAGAATGTGACAGAATGTG | 1893 | /5Phos/GTCACACATTCTGTCACATTCTGT |
| 358 | ACATAGTGGTACATAGTGGT | 1126 | /5Phos/TTCGACATAGTGGTACATAGTGGT | 1894 | /5Phos/GTCAACCACTATGTACCACTATGT |
| 359 | ACCACCACGTACCACCACGT | 1127 | /5Phos/TTCGACCACCACGTACCACCACGT | 1895 | /5Phos/GTCACGTGGTGGTACGTGGTGGT |
| 360 | ACCGACAGCTACCGACAGCT | 1128 | /5Phos/TTCGACCGACAGCTACCGACAGCT | 1896 | /5Phos/GTCAAGCTGTCGGTAGCTGTCGGT |
| 361 | ACCGGCTAGTACCGGCTAGT | 1129 | /5Phos/TTCGACCGGCTAGTACCGGCTAGT | 1897 | /5Phos/GTCAACTAGCCGGTACTAGCCGGT |
| 362 | ACCGTAGATTACCGTAGATT | 1130 | /5Phos/TTCGACCGTAGATTACCGTAGATT | 1898 | /5Phos/GTCAAATCTACGGTAATCTACGGT |
| 363 | ACCGTGACTTACCGTGACTT | 1131 | /5Phos/TTCGACCGTGACTTACCGTGACTT | 1899 | /5Phos/GTCAAAGTCACGGTAAGTCACGGT |
| 364 | ACCTCACAACACCTCACAAC | 1132 | /5Phos/TTCGACCTCACAACACCTCACAAC | 1900 | /5Phos/GTCAGTTGTGAGGTGTTGTGAGGT |
| 365 | ACCTTGTCCTACCTTGTCCT | 1133 | /5Phos/TTCGACCTTGTCCTACCTTGTCCT | 1901 | /5Phos/GTCAAGGACAAGGTAGGACAAGGT |
| 366 | ACGAAGCAGGACGAAGCAGG | 1134 | /5Phos/TTCGACGAAGCAGGACGAAGCAGG | 1902 | /5Phos/GTCACCTGCTTCGTCCTGCTTCGT |
| 367 | ACGACTGGACACGACTGGAC | 1135 | /5Phos/TTCGACGACTGGACACGACTGGAC | 1903 | /5Phos/GTCAGTCCAGTCGTGTCCAGTCGT |
| 368 | ACGAGAGCAGACGAGAGCAG | 1136 | /5Phos/TTCGACGAGAGCAGACGAGAGCAG | 1904 | /5Phos/GTCACTGCTCTCGTCTGCTCTCGT |
| 369 | ACGCCTGTTGACGCCTGTTG | 1137 | /5Phos/TTCGACGCCTGTTGACGCCTGTTG | 1905 | /5Phos/GTCACAACAGGCGTCAACAGGCGT |
| 370 | ACGCGACTTCACGCGACTTC | 1138 | /5Phos/TTCGACGCGACTTCACGCGACTTC | 1906 | /5Phos/GTCAGAAGTCGCGTGAAGTCGCGT |
| 371 | ACGGATTGATACGGATTGAT | 1139 | /5Phos/TTCGACGGATTGATACGGATTGAT | 1907 | /5Phos/GTCAATCAATCCGTATCAATCCGT |
| 372 | ACGGCTCATGACGGCTCATG | 1140 | /5Phos/TTCGACGGCTCATGACGGCTCATG | 1908 | /5Phos/GTCACATGAGCCGTCATGAGCCGT |
| 373 | ACGGTAAGATACGGTAAGAT | 1141 | /5Phos/TTCGACGGTAAGATACGGTAAGAT | 1909 | /5Phos/GTCAATCTTACCGTATCTTACCGT |
| 374 | ACGGTAGCACACGGTAGCAC | 1142 | /5Phos/TTCGACGGTAGCACACGGTAGCAC | 1910 | /5Phos/GTCAGTGCTACCGTGTGCTACCGT |
| 375 | ACGGTGTTCGACGGTGTTCG | 1143 | /5Phos/TTCGACGGTGTTCGACGGTGTTCG | 1911 | /5Phos/GTCACGAACACCGTCGAACACCGT |
| 376 | ACGTCGATGGACGTCGATGG | 1144 | /5Phos/TTCGACGTCGATGGACGTCGATGG | 1912 | /5Phos/GTCACCATCGACGTCCATCGACGT |
| 377 | ACGTGCAGACACGTGCAGAC | 1145 | /5Phos/TTCGACGTGCAGACACGTGCAGAC | 1913 | /5Phos/GTCAGTCTGCACGTGTCTGCACGT |
| 378 | ACGTTCCAGCACGTTCCAGC | 1146 | /5Phos/TTCGACGTTCCAGCACGTTCCAGC | 1914 | /5Phos/GTCAGCTGGAACGTGCTGGAACGT |
| 379 | ACTAGCTTGTACTAGCTTGT | 1147 | /5Phos/TTCGACTAGCTTGTACTAGCTTGT | 1915 | /5Phos/GTCAACAAGCTAGTACAAGCTAGT |
| 380 | ACTAGGACGCACTAGGACGC | 1148 | /5Phos/TTCGACTAGGACGCACTAGGACGC | 1916 | /5Phos/GTCAGCGTCCTAGTGCGTCCTAGT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 381 | ACTCACCTGGACTCACCTGG | 1149 | /5Phos/TTCGACTCACCTGGACTCACCTGG | 1917 | /5Phos/GTCACCAGGTGAGTCCAGGTGAGT |
| 382 | ACTCATATCGACTCATATCG | 1150 | /5Phos/TTCGACTCATATCGACTCATATCG | 1918 | /5Phos/GTCACGATATGAGTCGATATGAGT |
| 383 | ACTGACCGTGACTGACCGTG | 1151 | /5Phos/TTCGACTGACCGTGACTGACCGTG | 1919 | /5Phos/GTCACACGGTCAGTCACGGTCAGT |
| 384 | ACTTCTAACCACTTCTAACC | 1152 | /5Phos/TTCGACTTCTAACCACTTCTAACC | 1920 | /5Phos/GTCAGGTTAGAAGTGGTTAGAAGT |
| 385 | ACTTGGCGCTACTTGGCGCT | 1153 | /5Phos/TGACACTTGGCGCTACTTGGCGCT | 1921 | /5Phos/GGGAAGCGCCAAGTAGCGCCAAGT |
| 386 | AGAACGCTCCAGAACGCTCC | 1154 | /5Phos/TGACAGAACGCTCCAGAACGCTCC | 1922 | /5Phos/GGGAGGAGCGTTCTGGAGCGTTCT |
| 387 | AGAACTTAGGAGAACTTAGG | 1155 | /5Phos/TGACAGAACTTAGGAGAACTTAGG | 1923 | /5Phos/GGGACCTAAGTTCTCCTAAGTTCT |
| 388 | AGAAGCGCATAGAAGCGCAT | 1156 | /5Phos/TGACAGAAGCGCATAGAAGCGCAT | 1924 | /5Phos/GGGAATGCGCTTCTATGCGCTTCT |
| 389 | AGACAATAGCAGACAATAGC | 1157 | /5Phos/TGACAGACAATAGCAGACAATAGC | 1925 | /5Phos/GGGAGCTATTGTCTGCTATTGTCT |
| 390 | AGACCGAGACAGACCGAGAC | 1158 | /5Phos/TGACAGACCGAGACAGACCGAGAC | 1926 | /5Phos/GGGAGTCTCGGTCTGTCTCGGTCT |
| 391 | AGACGCTGTCAGACGCTGTC | 1159 | /5Phos/TGACAGACGCTGTCAGACGCTGTC | 1927 | /5Phos/GGGAGACAGCGTCTGACAGCGTCT |
| 392 | AGACGTAGCGAGACGTAGCG | 1160 | /5Phos/TGACAGACGTAGCGAGACGTAGCG | 1928 | /5Phos/GGGACGCTACGTCTCGCTACGTCT |
| 393 | AGAGAGCTCTAGAGAGCTCT | 1161 | /5Phos/TGACAGAGAGCTCTAGAGAGCTCT | 1929 | /5Phos/GGGAAGAGCTCTCTAGAGCTCTCT |
| 394 | AGAGGCCACTAGAGGCCACT | 1162 | /5Phos/TGACAGAGGCCACTAGAGGCCACT | 1930 | /5Phos/GGGAAGTGGCCTCTAGTGGCCTCT |
| 395 | AGATTGCCGCAGATTGCCGC | 1163 | /5Phos/TGACAGATTGCCGCAGATTGCCGC | 1931 | /5Phos/GGGAGCGGCAATCTGCGGCAATCT |
| 396 | AGCACGATGCAGCACGATGC | 1164 | /5Phos/TGACAGCACGATGCAGCACGATGC | 1932 | /5Phos/GGGAGCATCGTGCTGCATCGTGCT |
| 397 | AGCAGAGAATAGCAGAGAAT | 1165 | /5Phos/TGACAGCAGAGAATAGCAGAGAAT | 1933 | /5Phos/GGGAATTCTCTGCTATTCTCTGCT |
| 398 | AGCCACAAGGAGCCACAAGG | 1166 | /5Phos/TGACAGCCACAAGGAGCCACAAGG | 1934 | /5Phos/GGGACCTTGTGGCTCCTTGTGGCT |
| 399 | AGCCAGGAAGAGCCAGGAAG | 1167 | /5Phos/TGACAGCCAGGAAGAGCCAGGAAG | 1935 | /5Phos/GGGACTTCCTGGCTCTTCCTGGCT |
| 400 | AGCTCTGGAGAGCTCTGGAG | 1168 | /5Phos/TGACAGCTCTGGAGAGCTCTGGAG | 1936 | /5Phos/GGGACTCCAGAGCTCTCCAGAGCT |
| 401 | AGCTTGGCAGAGCTTGGCAG | 1169 | /5Phos/TGACAGCTTGGCAGAGCTTGGCAG | 1937 | /5Phos/GGGACTGCCAAGCTCTGCCAAGCT |
| 402 | AGGAATAACGAGGAATAACG | 1170 | /5Phos/TGACAGGAATAACGAGGAATAACG | 1938 | /5Phos/GGGACGTTATTCCTCGTTATTCCT |
| 403 | AGGAATTGACAGGAATTGAC | 1171 | /5Phos/TGACAGGAATTGACAGGAATTGAC | 1939 | /5Phos/GGGAGTCAATTCCTGTCAATTCCT |
| 404 | AGGAGGAATTAGGAGGAATT | 1172 | /5Phos/TGACAGGAGGAATTAGGAGGAATT | 1940 | /5Phos/GGGAAATTCCTCCTAATTCCTCCT |
| 405 | AGGATAGGCCAGGATAGGCC | 1173 | /5Phos/TGACAGGATAGGCCAGGATAGGCC | 1941 | /5Phos/GGGAGGCCTATCCTGGCCTATCCT |
| 406 | AGGTGGCCTTAGGTGGCCTT | 1174 | /5Phos/TGACAGGTGGCCTTAGGTGGCCTT | 1942 | /5Phos/GGGAAAGGCCACCTAAGGCCACCT |
| 407 | AGGTGTTGCGAGGTGTTGCG | 1175 | /5Phos/TGACAGGTGTTGCGAGGTGTTGCG | 1943 | /5Phos/GGGACGCAACACCTCGCAACACCT |
| 408 | AGGTTAGGTGAGGTTAGGTG | 1176 | /5Phos/TGACAGGTTAGGTGAGGTTAGGTG | 1944 | /5Phos/GGGACACCTAACCTCACCTAACCT |
| 409 | AGTCCGTCCTAGTCCGTCCT | 1177 | /5Phos/TGACAGTCCGTCCTAGTCCGTCCT | 1945 | /5Phos/GGGAAGGACGGACTAGGACGGACT |
| 410 | AGTCGATCCGAGTCGATCCG | 1178 | /5Phos/TGACAGTCGATCCGAGTCGATCCG | 1946 | /5Phos/GGGACGGATCGACTCGGATCGACT |
| 411 | AGTCGCTGCTAGTCGCTGCT | 1179 | /5Phos/TGACAGTCGCTGCTAGTCGCTGCT | 1947 | /5Phos/GGGAAGCAGCGACTAGCAGCGACT |
| 412 | AGTCGTCCTCAGTCGTCCTC | 1180 | /5Phos/TGACAGTCGTCCTCAGTCGTCCTC | 1948 | /5Phos/GGGAGAGGACGACTGAGGACGACT |
| 413 | AGTGTTCCGTAGTGTTCCGT | 1181 | /5Phos/TGACAGTGTTCCGTAGTGTTCCGT | 1949 | /5Phos/GGGAACGGAACACTACGGAACACT |
| 414 | AGTTGCTCATAGTTGCTCAT | 1182 | /5Phos/TGACAGTTGCTCATAGTTGCTCAT | 1950 | /5Phos/GGGAATGAGCAACTATGAGCAACT |
| 415 | ATAACGTGAGATAACGTGAG | 1183 | /5Phos/TGACATAACGTGAGATAACGTGAG | 1951 | /5Phos/GGGACTCACGTTATCTCACGTTAT |
| 416 | ATACGCAGGCATACGCAGGC | 1184 | /5Phos/TGACATACGCAGGCATACGCAGGC | 1952 | /5Phos/GGGAGCCTGCGTATGCCTGCGTAT |
| 417 | ATACTGATGCATACTGATGC | 1185 | /5Phos/TGACATACTGATGCATACTGATGC | 1953 | /5Phos/GGGAGCATCAGTATGCATCAGTAT |
| 418 | ATAGTTCGTCATAGTTCGTC | 1186 | /5Phos/TGACATAGTTCGTCATAGTTCGTC | 1954 | /5Phos/GGGAGACGAACTATGACGAACTAT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 419 | ATATCTTCGCATATCTTCGC | 1187 | /5Phos/TGACATATCTTCGCATATCTTCGC | 1955 | /5Phos/GGGAGCGAAGATATGCGAAGATAT |
| 420 | ATATGCCTTCATATGCCTTC | 1188 | /5Phos/TGACATATGCCTTCATATGCCTTC | 1956 | /5Phos/GGGAGAAGGCATATGAAGGCATAT |
| 421 | ATCAGATCACATCAGATCAC | 1189 | /5Phos/TGACATCAGATCACATCAGATCAC | 1957 | /5Phos/GGGAGTGATCTGATGTGATCTGAT |
| 422 | ATCCAATCTGATCCAATCTG | 1190 | /5Phos/TGACATCCAATCTGATCCAATCTG | 1958 | /5Phos/GGGACAGATTGGATCAGATTGGAT |
| 423 | ATCCACAGCGATCCACAGCG | 1191 | /5Phos/TGACATCCACAGCGATCCACAGCG | 1959 | /5Phos/GGGACGCTGTGGATCGCTGTGGAT |
| 424 | ATCCGGAACGATCCGGAACG | 1192 | /5Phos/TGACATCCGGAACGATCCGGAACG | 1960 | /5Phos/GGGACGTTCCGGATCGTTCCGGAT |
| 425 | ATCGGCTTCCATCGGCTTCC | 1193 | /5Phos/TGACATCGGCTTCCATCGGCTTCC | 1961 | /5Phos/GGGAGGAAGCCGATGGAAGCCGAT |
| 426 | ATCGTCGGAGATCGTCGGAG | 1194 | /5Phos/TGACATCGTCGGAGATCGTCGGAG | 1962 | /5Phos/GGGACTCCGACGATCTCCGACGAT |
| 427 | ATCTCTCACGATCTCTCACG | 1195 | /5Phos/TGACATCTCTCACGATCTCTCACG | 1963 | /5Phos/GGGACGTGAGAGATCGTGAGAGAT |
| 428 | ATGCACCTGCATGCACCTGC | 1196 | /5Phos/TGACATGCACCTGCATGCACCTGC | 1964 | /5Phos/GGGAGCAGGTGCATGCAGGTGCAT |
| 429 | ATGCAGTCGCATGCAGTCGC | 1197 | /5Phos/TGACATGCAGTCGCATGCAGTCGC | 1965 | /5Phos/GGGAGCGACTGCATGCGACTGCAT |
| 430 | ATGCCGTAGGATGCCGTAGG | 1198 | /5Phos/TGACATGCCGTAGGATGCCGTAGG | 1966 | /5Phos/GGGACCTACGGCATCCTACGGCAT |
| 431 | ATGCGCGATCATGCGCGATC | 1199 | /5Phos/TGACATGCGCGATCATGCGCGATC | 1967 | /5Phos/GGGAGATCGCGCATGATCGCGCAT |
| 432 | ATGTGGTGATATGTGGTGAT | 1200 | /5Phos/TGACATGTGGTGATATGTGGTGAT | 1968 | /5Phos/GGGAATCACCACATATCACCACAT |
| 433 | ATTACGAGCCATTACGAGCC | 1201 | /5Phos/TGACATTACGAGCCATTACGAGCC | 1969 | /5Phos/GGGAGGCTCGTAATGGCTCGTAAT |
| 434 | ATTCCACGGCATTCCACGGC | 1202 | /5Phos/TGACATTCCACGGCATTCCACGGC | 1970 | /5Phos/GGGAGCCGTGGAATGCCGTGGAAT |
| 435 | ATTCGGCGTCATTCGGCGTC | 1203 | /5Phos/TGACATTCGGCGTCATTCGGCGTC | 1971 | /5Phos/GGGAGACGCCGAATGACGCCGAAT |
| 436 | ATTGGAAGCCATTGGAAGCC | 1204 | /5Phos/TGACATTGGAAGCCATTGGAAGCC | 1972 | /5Phos/GGGAGGCTTCCAATGGCTTCCAAT |
| 437 | ATTGTCGGCCATTGTCGGCC | 1205 | /5Phos/TGACATTGTCGGCCATTGTCGGCC | 1973 | /5Phos/GGGAGGCCGACAATGGCCGACAAT |
| 438 | CAACCGCTTGCAACCGCTTG | 1206 | /5Phos/TGACCAACCGCTTGCAACCGCTTG | 1974 | /5Phos/GGGACAAGCGGTTGCAAGCGGTTG |
| 439 | CAACTGGTGGCAACTGGTGG | 1207 | /5Phos/TGACCAACTGGTGGCAACTGGTGG | 1975 | /5Phos/GGGACCACCAGTTGCCACCAGTTG |
| 440 | CAAGATGGTGCAAGATGGTG | 1208 | /5Phos/TGACCAAGATGGTGCAAGATGGTG | 1976 | /5Phos/GGGACACCATCTTGCACCATCTTG |
| 441 | CAAGATTCGACAAGATTCGA | 1209 | /5Phos/TGACCAAGATTCGACAAGATTCGA | 1977 | /5Phos/GGGATCGAATCTTGTCGAATCTTG |
| 442 | CAAGCACGAGCAAGCACGAG | 1210 | /5Phos/TGACCAAGCACGAGCAAGCACGAG | 1978 | /5Phos/GGGACTCGTGCTTGCTCGTGCTTG |
| 443 | CAAGCCTGTGCAAGCCTGTG | 1211 | /5Phos/TGACCAAGCCTGTGCAAGCCTGTG | 1979 | /5Phos/GGGACACAGGCTTGCACAGGCTTG |
| 444 | CAAGCTCACGCAAGCTCACG | 1212 | /5Phos/TGACCAAGCTCACGCAAGCTCACG | 1980 | /5Phos/GGGACGTGAGCTTGCGTGAGCTTG |
| 445 | CAAGGTTGCGCAAGGTTGCG | 1213 | /5Phos/TGACCAAGGTTGCGCAAGGTTGCG | 1981 | /5Phos/GGGACGCAACCTTGCGCAACCTTG |
| 446 | CAAGTCGACGCAAGTCGACG | 1214 | /5Phos/TGACCAAGTCGACGCAAGTCGACG | 1982 | /5Phos/GGGACGTCGACTTGCGTCGACTTG |
| 447 | CACCACGAAGCACCACGAAG | 1215 | /5Phos/TGACCACCACGAAGCACCACGAAG | 1983 | /5Phos/GGGACTTCGTGGTGCTTCGTGGTG |
| 448 | CACCGATATTCACCGATATT | 1216 | /5Phos/TGACCACCGATATTCACCGATATT | 1984 | /5Phos/GGGAAATATCGGTGAATATCGGTG |
| 449 | CACCGTCGAACACCGTCGAA | 1217 | /5Phos/TGACCACCGTCGAACACCGTCGAA | 1985 | /5Phos/GGGATTCGACGGTGTTCGACGGTG |
| 450 | CACCGTGACACACCGTGACA | 1218 | /5Phos/TGACCACCGTGACACACCGTGACA | 1986 | /5Phos/GGGATGTCACGGTGTGTCACGGTG |
| 451 | CACCTGCTGACACCTGCTGA | 1219 | /5Phos/TGACCACCTGCTGACACCTGCTGA | 1987 | /5Phos/GGGATCAGCAGGTGTCAGCAGGTG |
| 452 | CACGCACATACACGCACATA | 1220 | /5Phos/TGACCACGCACATACACGCACATA | 1988 | /5Phos/GGGATATGTGCGTGTATGTGCGTG |
| 453 | CACGCTAAGGCACGCTAAGG | 1221 | /5Phos/TGACCACGCTAAGGCACGCTAAGG | 1989 | /5Phos/GGGACCTTAGCGTGCCTTAGCGTG |
| 454 | CACGTAATCTCACGTAATCT | 1222 | /5Phos/TGACCACGTAATCTCACGTAATCT | 1990 | /5Phos/GGGAAGATTACGTGAGATTACGTG |
| 455 | CACGTGGAGTCACGTGGAGT | 1223 | /5Phos/TGACCACGTGGAGTCACGTGGAGT | 1991 | /5Phos/GGGAACTCCACGTGACTCCACGTG |
| 456 | CACTCGAGAGCACTCGAGAG | 1224 | /5Phos/TGACCACTCGAGAGCACTCGAGAG | 1992 | /5Phos/GGGACTCTCGAGTGCTCTCGAGTG |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 457 | CACTCTCTGACACTCTCTGA | 1225 | /5Phos/TGACCACTCTCTGACACTCTCTGA | 1993 | /5Phos/GGGATCAGAGAGTGTCAGAGAGTG |
| 458 | CACTCTGGCTCACTCTGGCT | 1226 | /5Phos/TGACCACTCTGGCTCACTCTGGCT | 1994 | /5Phos/GGGAAGCCAGAGTGAGCCAGAGTG |
| 459 | CACTGCCATGCACTGCCATG | 1227 | /5Phos/TGACCACTGCCATGCACTGCCATG | 1995 | /5Phos/GGGACATGGCAGTGCATGGCAGTG |
| 460 | CACTTGAACTCACTTGAACT | 1228 | /5Phos/TGACCACTTGAACTCACTTGAACT | 1996 | /5Phos/GGGAAGTTCAAGTGAGTTCAAGTG |
| 461 | CAGACCTGAGCAGACCTGAG | 1229 | /5Phos/TGACCAGACCTGAGCAGACCTGAG | 1997 | /5Phos/GGGACTCAGGTCTGCTCAGGTCTG |
| 462 | CAGCGAGCATCAGCGAGCAT | 1230 | /5Phos/TGACCAGCGAGCATCAGCGAGCAT | 1998 | /5Phos/GGGAATGCTCGCTGATGCTCGCTG |
| 463 | CAGGAAGAGGCAGGAAGAGG | 1231 | /5Phos/TGACCAGGAAGAGGCAGGAAGAGG | 1999 | /5Phos/GGGACCTCTTCCTGCCTCTTCCTG |
| 464 | CAGTCTCATACAGTCTCATA | 1232 | /5Phos/TGACCAGTCTCATACAGTCTCATA | 2000 | /5Phos/GGGATATGAGACTGTATGAGACTG |
| 465 | CAGTTATCGACAGTTATCGA | 1233 | /5Phos/TGACCAGTTATCGACAGTTATCGA | 2001 | /5Phos/GGGATCGATAACTGTCGATAACTG |
| 466 | CATACACGCGCATACACGCG | 1234 | /5Phos/TGACCATACACGCGCATACACGCG | 2002 | /5Phos/GGGACGCGTGTATGCGCGTGTATG |
| 467 | CATACCGACGCATACCGACG | 1235 | /5Phos/TGACCATACCGACGCATACCGACG | 2003 | /5Phos/GGGACGTCGGTATGCGTCGGTATG |
| 468 | CATCAATGGTCATCAATGGT | 1236 | /5Phos/TGACCATCAATGGTCATCAATGGT | 2004 | /5Phos/GGGAACCATTGATGACCATTGATG |
| 469 | CATGACACCGCATGACACCG | 1237 | /5Phos/TGACCATGACACCGCATGACACCG | 2005 | /5Phos/GGGACGGTGTCATGCGGTGTCATG |
| 470 | CATGGTTCGGCATGGTTCGG | 1238 | /5Phos/TGACCATGGTTCGGCATGGTTCGG | 2006 | /5Phos/GGGACCGAACCATGCCGAACCATG |
| 471 | CATTGGAGCGCATTGGAGCG | 1239 | /5Phos/TGACCATTGGAGCGCATTGGAGCG | 2007 | /5Phos/GGGACGCTCCAATGCGCTCCAATG |
| 472 | CCAACGAGAGCCAACGAGAG | 1240 | /5Phos/TGACCCAACGAGAGCCAACGAGAG | 2008 | /5Phos/GGGACTCTCGTTGGCTCTCGTTGG |
| 473 | CCAAGACCAGCCAAGACCAG | 1241 | /5Phos/TGACCCAAGACCAGCCAAGACCAG | 2009 | /5Phos/GGGACTGGTCTTGGCTGGTCTTGG |
| 474 | CCAATCACGGCCAATCACGG | 1242 | /5Phos/TGACCCAATCACGGCCAATCACGG | 2010 | /5Phos/GGGACCGTGATTGGCCGTGATTGG |
| 475 | CCACCGTTGTCCACCGTTGT | 1243 | /5Phos/TGACCCACCGTTGTCCACCGTTGT | 2011 | /5Phos/GGGAACAACGGTGGACAACGGTGG |
| 476 | CCAGATCGGACCAGATCGGA | 1244 | /5Phos/TGACCCAGATCGGACCAGATCGGA | 2012 | /5Phos/GGGATCCGATCTGGTCCGATCTGG |
| 477 | CCGAAGTCAGCCGAAGTCAG | 1245 | /5Phos/TGACCCGAAGTCAGCCGAAGTCAG | 2013 | /5Phos/GGGACTGACTTCGGCTGACTTCGG |
| 478 | CCGCTGAAGTCCGCTGAAGT | 1246 | /5Phos/TGACCCGCTGAAGTCCGCTGAAGT | 2014 | /5Phos/GGGAACTTCAGCGGACTTCAGCGG |
| 479 | CCGGACCATACCGGACCATA | 1247 | /5Phos/TGACCCGGACCATACCGGACCATA | 2015 | /5Phos/GGGATATGGTCCGGTATGGTCCGG |
| 480 | CCGTTCTAGGCCGTTCTAGG | 1248 | /5Phos/TGACCCGTTCTAGGCCGTTCTAGG | 2016 | /5Phos/GGGACCTAGAACGGCCTAGAACGG |
| 481 | CCTAATGCGGCCTAATGCGG | 1249 | /5Phos/TGACCCTAATGCGGCCTAATGCGG | 2017 | /5Phos/GGGACCGCATTAGGCCGCATTAGG |
| 482 | CCTATGACGACCTATGACGA | 1250 | /5Phos/TGACCCTATGACGACCTATGACGA | 2018 | /5Phos/GGGATCGTCATAGGTCGTCATAGG |
| 483 | CCTCACCAGTCCTCACCAGT | 1251 | /5Phos/TGACCCTCACCAGTCCTCACCAGT | 2019 | /5Phos/GGGAACTGGTGAGGACTGGTGAGG |
| 484 | CCTGAAGACGCCTGAAGACG | 1252 | /5Phos/TGACCCTGAAGACGCCTGAAGACG | 2020 | /5Phos/GGGACGTCTTCAGGCGTCTTCAGG |
| 485 | CCTGACTCCTCCTGACTCCT | 1253 | /5Phos/TGACCCTGACTCCTCCTGACTCCT | 2021 | /5Phos/GGGAAGGAGTCAGGAGGAGTCAGG |
| 486 | CGAAGAGTGGCGAAGAGTGG | 1254 | /5Phos/TGACCGAAGAGTGGCGAAGAGTGG | 2022 | /5Phos/GGGACCACTCTTCGCCACTCTTCG |
| 487 | CGAAGGTGGTCGAAGGTGGT | 1255 | /5Phos/TGACCGAAGGTGGTCGAAGGTGGT | 2023 | /5Phos/GGGAACCACCTTCGACCACCTTCG |
| 488 | CGACTAGCAGCGACTAGCAG | 1256 | /5Phos/TGACCGACTAGCAGCGACTAGCAG | 2024 | /5Phos/GGGACTGCTAGTCGCTGCTAGTCG |
| 489 | CGACTCGAGACGACTCGAGA | 1257 | /5Phos/TGACCGACTCGAGACGACTCGAGA | 2025 | /5Phos/GGGATCTCGAGTCGTCTCGAGTCG |
| 490 | CGACTTACAACGACTTACAA | 1258 | /5Phos/TGACCGACTTACAACGACTTACAA | 2026 | /5Phos/GGGATTGTAAGTCGTTGTAAGTCG |
| 491 | CGAGGATTAACGAGGATTAA | 1259 | /5Phos/TGACCGAGGATTAACGAGGATTAA | 2027 | /5Phos/GGGATTAATCCTCGTTAATCCTCG |
| 492 | CGAGGCATGTCGAGGCATGT | 1260 | /5Phos/TGACCGAGGCATGTCGAGGCATGT | 2028 | /5Phos/GGGAACATGCCTCGACATGCCTCG |
| 493 | CGAGTCTGCTCGAGTCTGCT | 1261 | /5Phos/TGACCGAGTCTGCTCGAGTCTGCT | 2029 | /5Phos/GGGAAGCAGACTCGAGCAGACTCG |
| 494 | CGAGTGAGCACGAGTGAGCA | 1262 | /5Phos/TGACCGAGTGAGCACGAGTGAGCA | 2030 | /5Phos/GGGATGCTCACTCGTGCTCACTCG |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 495 | CGATCGGAAGCGATCGGAAG | 1263 | /5Phos/TGACCGATCGGAAGCGATCGGAAG | 2031 | /5Phos/GGGACTTCCGATCGCTTCCGATCG |
| 496 | CGATCTACCGCGATCTACCG | 1264 | /5Phos/TGACCGATCTACCGCGATCTACCG | 2032 | /5Phos/GGGACGGTAGATCGCGGTAGATCG |
| 497 | CGCCAAGCTTCGCCAAGCTT | 1265 | /5Phos/TGACCGCCAAGCTTCGCCAAGCTT | 2033 | /5Phos/GGGAAGCTTGGCGAAGCTTGGCG |
| 498 | CGCCAGAATTCGCCAGAATT | 1266 | /5Phos/TGACCGCCAGAATTCGCCAGAATT | 2034 | /5Phos/GGGAAATTCTGGCGAATTCTGGCG |
| 499 | CGCGAATGGACGCGAATGGA | 1267 | /5Phos/TGACCGCGAATGGACGCGAATGGA | 2035 | /5Phos/GGGATCCATTCGCGTCCATTCGCG |
| 500 | CGCTCATCCTCGCTCATCCT | 1268 | /5Phos/TGACCGCTCATCCTCGCTCATCCT | 2036 | /5Phos/GGGAAGGATGAGCGAGGATGAGCG |
| 501 | CGCTCGAATGCGCTCGAATG | 1269 | /5Phos/TGACCGCTCGAATGCGCTCGAATG | 2037 | /5Phos/GGGACATTCGAGCGCATTCGAGCG |
| 502 | CGCTTACTATCGCTTACTAT | 1270 | /5Phos/TGACCGCTTACTATCGCTTACTAT | 2038 | /5Phos/GGGAATAGTAAGCGATAGTAAGCG |
| 503 | CGCTTAGCGTCGCTTAGCGT | 1271 | /5Phos/TGACCGCTTAGCGTCGCTTAGCGT | 2039 | /5Phos/GGGAACGCTAAGCGACGCTAAGCG |
| 504 | CGGACTTAAGCGGACTTAAG | 1272 | /5Phos/TGACCGGACTTAAGCGGACTTAAG | 2040 | /5Phos/GGGACTTAAGTCCGCTTAAGTCCG |
| 505 | CGGCGAACAACGGCGAACAA | 1273 | /5Phos/TGACCGGCGAACAACGGCGAACAA | 2041 | /5Phos/GGGATTGTTCGCCGTTGTTCGCCG |
| 506 | CGGCTTGGAACGGCTTGGAA | 1274 | /5Phos/TGACCGGCTTGGAACGGCTTGGAA | 2042 | /5Phos/GGGATTCCAAGCCGTTCCAAGCCG |
| 507 | CGGTAGTGCTCGGTAGTGCT | 1275 | /5Phos/TGACCGGTAGTGCTCGGTAGTGCT | 2043 | /5Phos/GGGAAGCACTACCGAGCACTACCG |
| 508 | CGGTTACACACGGTTACACA | 1276 | /5Phos/TGACCGGTTACACACGGTTACACA | 2044 | /5Phos/GGGATGTGTAACCGTGTGTAACCG |
| 509 | CGTACCGTGTCGTACCGTGT | 1277 | /5Phos/TGACCGTACCGTGTCGTACCGTGT | 2045 | /5Phos/GGGAACACGGTACGACACGGTACG |
| 510 | CGTAGAGCCACGTAGAGCCA | 1278 | /5Phos/TGACCGTAGAGCCACGTAGAGCCA | 2046 | /5Phos/GGGATGGCTCTACGTGGCTCTACG |
| 511 | CGTAGGACTGCGTAGGACTG | 1279 | /5Phos/TGACCGTAGGACTGCGTAGGACTG | 2047 | /5Phos/GGGACAGTCCTACGCAGTCCTACG |
| 512 | CGTATCACAACGTATCACAA | 1280 | /5Phos/TGACCGTATCACAACGTATCACAA | 2048 | /5Phos/GGGATTGTGATACGTTGTGATACG |
| 513 | CGTGTTGCGACGTGTTGCGA | 1281 | /5Phos/TGACCGTGTTGCGACGTGTTGCGA | 2049 | /5Phos/GGGATCGCAACACGTCGCAACACG |
| 514 | CGTTGGTCCACGTTGGTCCA | 1282 | /5Phos/TGACCGTTGGTCCACGTTGGTCCA | 2050 | /5Phos/GGGATGGACCAACGTGGACCAACG |
| 515 | CTACAGCCGACTACAGCCGA | 1283 | /5Phos/TGACCTACAGCCGACTACAGCCGA | 2051 | /5Phos/GGGATCGGCTGTAGTCGGCTGTAG |
| 516 | CTACGCAAGGCTACGCAAGG | 1284 | /5Phos/TGACCTACGCAAGGCTACGCAAGG | 2052 | /5Phos/GGGACCTTGCGTAGCCTTGCGTAG |
| 517 | CTACGGTGTGCTACGGTGTG | 1285 | /5Phos/TGACCTACGGTGTGCTACGGTGTG | 2053 | /5Phos/GGGACACACCGTAGCACACCGTAG |
| 518 | CTACGTTCCTCTACGTTCCT | 1286 | /5Phos/TGACCTACGTTCCTCTACGTTCCT | 2054 | /5Phos/GGGAAGGAACGTAGAGGAACGTAG |
| 519 | CTAGAGGCAGCTAGAGGCAG | 1287 | /5Phos/TGACCTAGAGGCAGCTAGAGGCAG | 2055 | /5Phos/GGGACTGCCTCTAGCTGCCTCTAG |
| 520 | CTAGGTCCAGCTAGGTCCAG | 1288 | /5Phos/TGACCTAGGTCCAGCTAGGTCCAG | 2056 | /5Phos/GGGACTGGACCTAGCTGGACCTAG |
| 521 | CTAGGTCGCTCTAGGTCGCT | 1289 | /5Phos/TGACCTAGGTCGCTCTAGGTCGCT | 2057 | /5Phos/GGGAAGCGACCTAGAGCGACCTAG |
| 522 | CTATCGCCGTCTATCGCCGT | 1290 | /5Phos/TGACCTATCGCCGTCTATCGCCGT | 2058 | /5Phos/GGGAACGGCGATAGACGGCGATAG |
| 523 | CTATGGATCTCTATGGATCT | 1291 | /5Phos/TGACCTATGGATCTCTATGGATCT | 2059 | /5Phos/GGGAAGATCCATAGAGATCCATAG |
| 524 | CTCGCGAGTTCTCGCGAGTT | 1292 | /5Phos/TGACCTCGCGAGTTCTCGCGAGTT | 2060 | /5Phos/GGGAAACTCGCGAGAACTCGCGAG |
| 525 | CTCGTGGCAACTCGTGGCAA | 1293 | /5Phos/TGACCTCGTGGCAACTCGTGGCAA | 2061 | /5Phos/GGGATTGCCACGAGTTGCCACGAG |
| 526 | CTCTACAACTCTCTACAACT | 1294 | /5Phos/TGACCTCTACAACTCTCTACAACT | 2062 | /5Phos/GGGAAGTTGTAGAGAGTTGTAGAG |
| 527 | CTCTATATCGCTCTATATCG | 1295 | /5Phos/TGACCTCTATATCGCTCTATATCG | 2063 | /5Phos/GGGACGATATAGAGCGATATAGAG |
| 528 | CTCTCCTTCACTCTCCTTCA | 1296 | /5Phos/TGACCTCTCCTTCACTCTCCTTCA | 2064 | /5Phos/GGGATGAAGGAGAGTGAAGGAGAG |
| 529 | CTCTCTTGCGCTCTCTTGCG | 1297 | /5Phos/TGACCTCTCTTGCGCTCTCTTGCG | 2065 | /5Phos/GGGACGCAAGAGAGCGCAAGAGAG |
| 530 | CTCTGCGTTGCTCTGCGTTG | 1298 | /5Phos/TGACCTCTGCGTTGCTCTGCGTTG | 2066 | /5Phos/GGGACAACGCAGAGCAACGCAGAG |
| 531 | CTGAATCCAGCTGAATCCAG | 1299 | /5Phos/TGACCTGAATCCAGCTGAATCCAG | 2067 | /5Phos/GGGACTGGATTCAGCTGGATTCAG |
| 532 | CTGAGCTTGGCTGAGCTTGG | 1300 | /5Phos/TGACCTGAGCTTGGCTGAGCTTGG | 2068 | /5Phos/GGGACCAAGCTCAGCCAAGCTCAG |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 533 | CTGGATCCGACTGGATCCGA | 1301 | /5Phos/TGACCTGGATCCGACTGGATCCGA | 2069 | /5Phos/GGGATCGGATCCAGTCGGATCCAG |
| 534 | CTGGTCTGATCTGGTCTGAT | 1302 | /5Phos/TGACCTGGTCTGATCTGGTCTGAT | 2070 | /5Phos/GGGAATCAGACCAGATCAGACCAG |
| 535 | CTGTCCACAGCTGTCCACAG | 1303 | /5Phos/TGACCTGTCCACAGCTGTCCACAG | 2071 | /5Phos/GGGACTGTGGACAGCTGTGGACAG |
| 536 | CTGTCCTCCTCTGTCCTCCT | 1304 | /5Phos/TGACCTGTCCTCCTCTGTCCTCCT | 2072 | /5Phos/GGGAAGGAGGACAGAGGAGGACAG |
| 537 | CTGTCGGATGCTGTCGGATG | 1305 | /5Phos/TGACCTGTCGGATGCTGTCGGATG | 2073 | /5Phos/GGGACATCCGACAGCATCCGACAG |
| 538 | CTTCATCTGACTTCATCTGA | 1306 | /5Phos/TGACCTTCATCTGACTTCATCTGA | 2074 | /5Phos/GGGATCAGATGAAGTCAGATGAAG |
| 539 | CTTCCTGCGTCTTCCTGCGT | 1307 | /5Phos/TGACCTTCCTGCGTCTTCCTGCGT | 2075 | /5Phos/GGGAACGCAGGAAGACGCAGGAAG |
| 540 | CTTCGGCTAGCTTCGGCTAG | 1308 | /5Phos/TGACCTTCGGCTAGCTTCGGCTAG | 2076 | /5Phos/GGGACTAGCCGAAGCTAGCCGAAG |
| 541 | CTTCTTATGGCTTCTTATGG | 1309 | /5Phos/TGACCTTCTTATGGCTTCTTATGG | 2077 | /5Phos/GGGACCATAAGAAGCCATAAGAAG |
| 542 | CTTCTTGGATCTTCTTGGAT | 1310 | /5Phos/TGACCTTCTTGGATCTTCTTGGAT | 2078 | /5Phos/GGGAATCCAAGAAGATCCAAGAAG |
| 543 | CTTGCGATGGCTTGCGATGG | 1311 | /5Phos/TGACCTTGCGATGGCTTGCGATGG | 2079 | /5Phos/GGGACCATCGCAAGCCATCGCAAG |
| 544 | GAACCTCAGCGAACCTCAGC | 1312 | /5Phos/TGACGAACCTCAGCGAACCTCAGC | 2080 | /5Phos/GGGAGCTGAGGTTCGCTGAGGTTC |
| 545 | GAACGGATTAGAACGGATTA | 1313 | /5Phos/TGACGAACGGATTAGAACGGATTA | 2081 | /5Phos/GGGATAATCCGTTCTAATCCGTTC |
| 546 | GAACGTCATTGAACGTCATT | 1314 | /5Phos/TGACGAACGTCATTGAACGTCATT | 2082 | /5Phos/GGGAAATGACGTTCAATGACGTTC |
| 547 | GAACTGATCCGAACTGATCC | 1315 | /5Phos/TGACGAACTGATCCGAACTGATCC | 2083 | /5Phos/GGGAGGATCAGTTCGGATCAGTTC |
| 548 | GACAGCAGTCGACAGCAGTC | 1316 | /5Phos/TGACGACAGCAGTCGACAGCAGTC | 2084 | /5Phos/GGGAGACTGCTGTCGACTGCTGTC |
| 549 | GACCGAATGTGACCGAATGT | 1317 | /5Phos/TGACGACCGAATGTGACCGAATGT | 2085 | /5Phos/GGGAACATTCGGTCACATTCGGTC |
| 550 | GACGCCATCAGACGCCATCA | 1318 | /5Phos/TGACGACGCCATCAGACGCCATCA | 2086 | /5Phos/GGGATGATGGCGTCTGATGGCGTC |
| 551 | GACGCGATACGACGCGATAC | 1319 | /5Phos/TGACGACGCGATACGACGCGATAC | 2087 | /5Phos/GGGAGTATCGCGTCGTATCGCGTC |
| 552 | GACGCTGTGAGACGCTGTGA | 1320 | /5Phos/TGACGACGCTGTGAGACGCTGTGA | 2088 | /5Phos/GGGATCACAGCGTCTCACAGCGTC |
| 553 | GACGGACCTTGACGGACCTT | 1321 | /5Phos/TGACGACGGACCTTGACGGACCTT | 2089 | /5Phos/GGGAAAGGTCCGTCAAGGTCCGTC |
| 554 | GACGGAGTCTGACGGAGTCT | 1322 | /5Phos/TGACGACGGAGTCTGACGGAGTCT | 2090 | /5Phos/GGGAAGACTCCGTCAGACTCCGTC |
| 555 | GAGCACAACCGAGCACAACC | 1323 | /5Phos/TGACGAGCACAACCGAGCACAACC | 2091 | /5Phos/GGGAGGTTGTGCTCGGTTGTGCTC |
| 556 | GAGGAAGACCGAGGAAGACC | 1324 | /5Phos/TGACGAGGAAGACCGAGGAAGACC | 2092 | /5Phos/GGGAGGTCTTCCTCGGTCTTCCTC |
| 557 | GAGGCACGATGAGGCACGAT | 1325 | /5Phos/TGACGAGGCACGATGAGGCACGAT | 2093 | /5Phos/GGGAATCGTGCCTCATCGTGCCTC |
| 558 | GAGGTGAAGCGAGGTGAAGC | 1326 | /5Phos/TGACGAGGTGAAGCGAGGTGAAGC | 2094 | /5Phos/GGGAGCTTCACCTCGCTTCACCTC |
| 559 | GAGTCACACCGAGTCACACC | 1327 | /5Phos/TGACGAGTCACACCGAGTCACACC | 2095 | /5Phos/GGGAGGTGTGACTCGGTGTGACTC |
| 560 | GAGTCCAGACGAGTCCAGAC | 1328 | /5Phos/TGACGAGTCCAGACGAGTCCAGAC | 2096 | /5Phos/GGGAGTCTGGACTCGTCTGGACTC |
| 561 | GATAACCTGTGATAACCTGT | 1329 | /5Phos/TGACGATAACCTGTGATAACCTGT | 2097 | /5Phos/GGGAACAGGTTATCACAGGTTATC |
| 562 | GATCCAAGGCGATCCAAGGC | 1330 | /5Phos/TGACGATCCAAGGCGATCCAAGGC | 2098 | /5Phos/GGGAGCCTTGGATCGCCTTGGATC |
| 563 | GATCGAGCCAGATCGAGCCA | 1331 | /5Phos/TGACGATCGAGCCAGATCGAGCCA | 2099 | /5Phos/GGGATGGCTCGATCGGCTCGATC |
| 564 | GATGGCAATCGATGGCAATC | 1332 | /5Phos/TGACGATGGCAATCGATGGCAATC | 2100 | /5Phos/GGGAGATTGCCATCGATTGCCATC |
| 565 | GATTACCAACGATTACCAAC | 1333 | /5Phos/TGACGATTACCAACGATTACCAAC | 2101 | /5Phos/GGGAGTTGGTAATCGTTGGTAATC |
| 566 | GATTCGTCTTGATTCGTCTT | 1334 | /5Phos/TGACGATTCGTCTTGATTCGTCTT | 2102 | /5Phos/GGGAAAGACGAATCAAGACGAATC |
| 567 | GATTGTTGGAGATTGTTGGA | 1335 | /5Phos/TGACGATTGTTGGAGATTGTTGGA | 2103 | /5Phos/GGGATCCAACAATCTCCAACAATC |
| 568 | GCAACACGGAGCAACACGGA | 1336 | /5Phos/TGACGCAACACGGAGCAACACGGA | 2104 | /5Phos/GGGATCCGTGTTGCTCCGTGTTGC |
| 569 | GCAATGGTACGCAATGGTAC | 1337 | /5Phos/TGACGCAATGGTACGCAATGGTAC | 2105 | /5Phos/GGGAGTACCATTGCGTACCATTGC |
| 570 | GCACCACATTGCACCACATT | 1338 | /5Phos/TGACGCACCACATTGCACCACATT | 2106 | /5Phos/GGGAAATGTGGTGCAATGTGGTGC |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 571 | GCAGATTGGCGCAGATTGGC | 1339 | /5Phos/TGACGCAGATTGGCGCAGATTGGC | 2107 | /5Phos/GGGAGCCAATCTGCGCCAATCTGC |
| 572 | GCAGGATAGCGCAGGATAGC | 1340 | /5Phos/TGACGCAGGATAGCGCAGGATAGC | 2108 | /5Phos/GGGAGCTATCCTGCGCTATCCTGC |
| 573 | GCATTAATCCGCATTAATCC | 1341 | /5Phos/TGACGCATTAATCCGCATTAATCC | 2109 | /5Phos/GGGAGGATTAATGCGGATTAATGC |
| 574 | GCCACCATCTGCCACCATCT | 1342 | /5Phos/TGACGCCACCATCTGCCACCATCT | 2110 | /5Phos/GGGAAGATGGTGGCAGATGGTGGC |
| 575 | GCCAGATACCGCCAGATACC | 1343 | /5Phos/TGACGCCAGATACCGCCAGATACC | 2111 | /5Phos/GGGAGGTATCTGGCGGTATCTGGC |
| 576 | GCCATAGATAGCCATAGATA | 1344 | /5Phos/TGACGCCATAGATAGCCATAGATA | 2112 | /5Phos/GGGATATCTATGGCTATCTATGGC |
| 577 | GCCATTGGACGCCATTGGAC | 1345 | /5Phos/TCCCGCCATTGGACGCCATTGGAC | 2113 | /5Phos/GTTGGTCCAATGGCGTCCAATGGC |
| 578 | GCCGAATCCTGCCGAATCCT | 1346 | /5Phos/TCCCGCCGAATCCTGCCGAATCCT | 2114 | /5Phos/GTTGAGGATTCGGCAGGATTCGGC |
| 579 | GCCGTGTCTAGCCGTGTCTA | 1347 | /5Phos/TCCCGCCGTGTCTAGCCGTGTCTA | 2115 | /5Phos/GTTGTAGACACGGCTAGACACGGC |
| 580 | GCCTTATCTCGCCTTATCTC | 1348 | /5Phos/TCCCGCCTTATCTCGCCTTATCTC | 2116 | /5Phos/GTTGGAGATAAGGCGAGATAAGGC |
| 581 | GCCTTCGCTTGCCTTCGCTT | 1349 | /5Phos/TCCCGCCTTCGCTTGCCTTCGCTT | 2117 | /5Phos/GTTGAAGCGAAGGCAAGCGAAGGC |
| 582 | GCGAAGTGGTGCGAAGTGGT | 1350 | /5Phos/TCCCGCGAAGTGGTGCGAAGTGGT | 2118 | /5Phos/GTTGACCACTTCGCACCACTTCGC |
| 583 | GCGAATATCTGCGAATATCT | 1351 | /5Phos/TCCCGCGAATATCTGCGAATATCT | 2119 | /5Phos/GTTGAGATATTCGCAGATATTCGC |
| 584 | GCGCTGATACGCGCTGATAC | 1352 | /5Phos/TCCCGCGCTGATACGCGCTGATAC | 2120 | /5Phos/GTTGGTATCAGCGCGTATCAGCGC |
| 585 | GCGGACTTCTGCGGACTTCT | 1353 | /5Phos/TCCCGCGGACTTCTGCGGACTTCT | 2121 | /5Phos/GTTGAGAAGTCCGCAGAAGTCCGC |
| 586 | GCGGATAAGTGCGGATAAGT | 1354 | /5Phos/TCCCGCGGATAAGTGCGGATAAGT | 2122 | /5Phos/GTTGACTTATCCGCACTTATCCGC |
| 587 | GCGGTCCATTGCGGTCCATT | 1355 | /5Phos/TCCCGCGGTCCATTGCGGTCCATT | 2123 | /5Phos/GTTGAATGGACCGCAATGGACCGC |
| 588 | GCTCAGTTAAGCTCAGTTAA | 1356 | /5Phos/TCCCGCTCAGTTAAGCTCAGTTAA | 2124 | /5Phos/GTTGTTAACTGAGCTTAACTGAGC |
| 589 | GCTCATTCTAGCTCATTCTA | 1357 | /5Phos/TCCCGCTCATTCTAGCTCATTCTA | 2125 | /5Phos/GTTGTAGAATGAGCTAGAATGAGC |
| 590 | GCTCCTAAGCGCTCCTAAGC | 1358 | /5Phos/TCCCGCTCCTAAGCGCTCCTAAGC | 2126 | /5Phos/GTTGGCTTAGGAGCGCTTAGGAGC |
| 591 | GCTGGAAGGAGCTGGAAGGA | 1359 | /5Phos/TCCCGCTGGAAGGAGCTGGAAGGA | 2127 | /5Phos/GTTGTCCTTCCAGCTCCTTCCAGC |
| 592 | GGAACAATGTGGAACAATGT | 1360 | /5Phos/TCCCGGAACAATGTGGAACAATGT | 2128 | /5Phos/GTTGACATTGTTCCACATTGTTCC |
| 593 | GGAACATCTCGGAACATCTC | 1361 | /5Phos/TCCCGGAACATCTCGGAACATCTC | 2129 | /5Phos/GTTGGAGATGTTCCGAGATGTTCC |
| 594 | GGAACCAGTAGGAACCAGTA | 1362 | /5Phos/TCCCGGAACCAGTAGGAACCAGTA | 2130 | /5Phos/GTTGTACTGGTTCCTACTGGTTCC |
| 595 | GGAACGACTTGGAACGACTT | 1363 | /5Phos/TCCCGGAACGACTTGGAACGACTT | 2131 | /5Phos/GTTGAAGTCGTTCCAAGTCGTTCC |
| 596 | GGAAGATGATGGAAGATGAT | 1364 | /5Phos/TCCCGGAAGATGATGGAAGATGAT | 2132 | /5Phos/GTTGATCATCTTCCATCATCTTCC |
| 597 | GGAAGGAGACGGAAGGAGAC | 1365 | /5Phos/TCCCGGAAGGAGACGGAAGGAGAC | 2133 | /5Phos/GTTGGTCTCCTTCCGTCTCCTTCC |
| 598 | GGAAGTGGTAGGAAGTGGTA | 1366 | /5Phos/TCCCGGAAGTGGTAGGAAGTGGTA | 2134 | /5Phos/GTTGTACCACTTCCTACCACTTCC |
| 599 | GGAATCAGGTGGAATCAGGT | 1367 | /5Phos/TCCCGGAATCAGGTGGAATCAGGT | 2135 | /5Phos/GTTGACCTGATTCCACCTGATTCC |
| 600 | GGAATGTGTAGGAATGTGTA | 1368 | /5Phos/TCCCGGAATGTGTAGGAATGTGTA | 2136 | /5Phos/GTTGTACACATTCCTACACATTCC |
| 601 | GGAGATAGGAGGAGATAGGA | 1369 | /5Phos/TCCCGGAGATAGGAGGAGATAGGA | 2137 | /5Phos/GTTGTCCTATCTCCTCCTATCTCC |
| 602 | GGAGCAATCCGGAGCAATCC | 1370 | /5Phos/TCCCGGAGCAATCCGGAGCAATCC | 2138 | /5Phos/GTTGGGATTGCTCCGGATTGCTCC |
| 603 | GGAGGACATCGGAGGACATC | 1371 | /5Phos/TCCCGGAGGACATCGGAGGACATC | 2139 | /5Phos/GTTGGATGTCCTCCGATGTCCTCC |
| 604 | GGCAATAGCCGGCAATAGCC | 1372 | /5Phos/TCCCGGCAATAGCCGGCAATAGCC | 2140 | /5Phos/GTTGGGCTATTGCCGGCTATTGCC |
| 605 | GGCAGAAGGAGGCAGAAGGA | 1373 | /5Phos/TCCCGGCAGAAGGAGGCAGAAGGA | 2141 | /5Phos/GTTGTCCTTCTGCCTCCTTCTGCC |
| 606 | GGCAGGAATAGGCAGGAATA | 1374 | /5Phos/TCCCGGCAGGAATAGGCAGGAATA | 2142 | /5Phos/GTTGTATTCCTGCCTATTCCTGCC |
| 607 | GGCATACACCGGCATACACC | 1375 | /5Phos/TCCCGGCATACACCGGCATACACC | 2143 | /5Phos/GTTGGGGTGTATGCCGGTGTATGCC |
| 608 | GGCCGTTGTAGGCCGTTGTA | 1376 | /5Phos/TCCCGGCCGTTGTAGGCCGTTGTA | 2144 | /5Phos/GTTGTACAACGGCCTACAACGGCC |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 609 | GGCCTGCTTAGGCCTGCTTA | 1377 | /5Phos/TCCCGGCCTGCTTAGGCCTGCTTA | 2145 | /5Phos/GTTGTAAGCAGGCCTAAGCAGGCC |
| 610 | GGCGAGGTAAGGCGAGGTAA | 1378 | /5Phos/TCCCGGCGAGGTAAGGCGAGGTAA | 2146 | /5Phos/GTTGTTACCTCGCCTTACCTCGCC |
| 611 | GGCGTGACATGGCGTGACAT | 1379 | /5Phos/TCCCGGCGTGACATGGCGTGACAT | 2147 | /5Phos/GTTGATGTCACGCCATGTCACGCC |
| 612 | GGCTCCAAGAGGCTCCAAGA | 1380 | /5Phos/TCCCGGCTCCAAGAGGCTCCAAGA | 2148 | /5Phos/GTTGTCTTGGAGCCTCTTGGAGCC |
| 613 | GGCTGCTCAAGGCTGCTCAA | 1381 | /5Phos/TCCCGGCTGCTCAAGGCTGCTCAA | 2149 | /5Phos/GTTGTTGAGCAGCCTTGAGCAGCC |
| 614 | GGCTGTGCTTGGCTGTGCTT | 1382 | /5Phos/TCCCGGCTGTGCTTGGCTGTGCTT | 2150 | /5Phos/GTTGAAGCACAGCCAAGCACAGCC |
| 615 | GGCTTCTGTCGGCTTCTGTC | 1383 | /5Phos/TCCCGGCTTCTGTCGGCTTCTGTC | 2151 | /5Phos/GTTGGACAGAAGCCGACAGAAGCC |
| 616 | GGTATCGCTTGGTATCGCTT | 1384 | /5Phos/TCCCGGTATCGCTTGGTATCGCTT | 2152 | /5Phos/GTTGAAGCGATACCAAGCGATACC |
| 617 | GGTCCTTCCAGGTCCTTCCA | 1385 | /5Phos/TCCCGGTCCTTCCAGGTCCTTCCA | 2153 | /5Phos/GTTGTGGAAGGACCTGGAAGGACC |
| 618 | GGTCGGTTATGGTCGGTTAT | 1386 | /5Phos/TCCCGGTCGGTTATGGTCGGTTAT | 2154 | /5Phos/GTTGATAACCGACCATAACCGACC |
| 619 | GGTCTGACGAGGTCTGACGA | 1387 | /5Phos/TCCCGGTCTGACGAGGTCTGACGA | 2155 | /5Phos/GTTGTCGTCAGACCTCGTCAGACC |
| 620 | GGTGACCACTGGTGACCACT | 1388 | /5Phos/TCCCGGTGACCACTGGTGACCACT | 2156 | /5Phos/GTTGAGTGGTCACCAGTGGTCACC |
| 621 | GGTGAGTCCAGGTGAGTCCA | 1389 | /5Phos/TCCCGGTGAGTCCAGGTGAGTCCA | 2157 | /5Phos/GTTGTGGACTCACCTGGACTCACC |
| 622 | GGTGGCGAATGGTGGCGAAT | 1390 | /5Phos/TCCCGGTGGCGAATGGTGGCGAAT | 2158 | /5Phos/GTTGATTCGCCACCATTCGCCACC |
| 623 | GGTGTATATCGGTGTATATC | 1391 | /5Phos/TCCCGGTGTATATCGGTGTATATC | 2159 | /5Phos/GTTGGATATACACCGATATACACC |
| 624 | GGTTCCTTAAGGTTCCTTAA | 1392 | /5Phos/TCCCGGTTCCTTAAGGTTCCTTAA | 2160 | /5Phos/GTTGTTAAGGAACCTTAAGGAACC |
| 625 | GGTTCTACAAGGTTCTACAA | 1393 | /5Phos/TCCCGGTTCTACAAGGTTCTACAA | 2161 | /5Phos/GTTGTTGTAGAACCTTGTAGAACC |
| 626 | GGTTGGCGTTGGTTGGCGTT | 1394 | /5Phos/TCCCGGTTGGCGTTGGTTGGCGTT | 2162 | /5Phos/GTTGAACGCCAACCAACGCCAACC |
| 627 | GTAACACGCTGTAACACGCT | 1395 | /5Phos/TCCCGTAACACGCTGTAACACGCT | 2163 | /5Phos/GTTGAGCGTGTTACAGCGTGTTAC |
| 628 | GTAGAGCGACGTAGAGCGAC | 1396 | /5Phos/TCCCGTAGAGCGACGTAGAGCGAC | 2164 | /5Phos/GTTGGTCGCTCTACGTCGCTCTAC |
| 629 | GTAGCTGCTCGTAGCTGCTC | 1397 | /5Phos/TCCCGTAGCTGCTCGTAGCTGCTC | 2165 | /5Phos/GTTGGAGCAGCTACGAGCAGCTAC |
| 630 | GTAGGTGGATGTAGGTGGAT | 1398 | /5Phos/TCCCGTAGGTGGATGTAGGTGGAT | 2166 | /5Phos/GTTGATCCACCTACATCCACCTAC |
| 631 | GTAGTCAGCCGTAGTCAGCC | 1399 | /5Phos/TCCCGTAGTCAGCCGTAGTCAGCC | 2167 | /5Phos/GTTGGGCTGACTACGGCTGACTAC |
| 632 | GTCCTTCCACGTCCTTCCAC | 1400 | /5Phos/TCCCGTCCTTCCACGTCCTTCCAC | 2168 | /5Phos/GTTGGTGGAAGGACGTGGAAGGAC |
| 633 | GTCGAGCAGTGTCGAGCAGT | 1401 | /5Phos/TCCCGTCGAGCAGTGTCGAGCAGT | 2169 | /5Phos/GTTGACTGCTCGACACTGCTCGAC |
| 634 | GTCGCACAGAGTCGCACAGA | 1402 | /5Phos/TCCCGTCGCACAGAGTCGCACAGA | 2170 | /5Phos/GTTGTCTGTGCGACTCTGTGCGAC |
| 635 | GTCGCACTTCGTCGCACTTC | 1403 | /5Phos/TCCCGTCGCACTTCGTCGCACTTC | 2171 | /5Phos/GTTGGAAGTGCGACGAAGTGCGAC |
| 636 | GTCTGGTGGTGTCTGGTGGT | 1404 | /5Phos/TCCCGTCTGGTGGTGTCTGGTGGT | 2172 | /5Phos/GTTGACCACCAGACACCACCAGAC |
| 637 | GTGAACTGTTGTGAACTGTT | 1405 | /5Phos/TCCCGTGAACTGTTGTGAACTGTT | 2173 | /5Phos/GTTGAACAGTTCACAACAGTTCAC |
| 638 | GTGCCATCCTGTGCCATCCT | 1406 | /5Phos/TCCCGTGCCATCCTGTGCCATCCT | 2174 | /5Phos/GTTGAGGATGGCACAGGATGGCAC |
| 639 | GTGCGTGAACGTGCGTGAAC | 1407 | /5Phos/TCCCGTGCGTGAACGTGCGTGAAC | 2175 | /5Phos/GTTGGTTCACGCACGTTCACGCAC |
| 640 | GTGGAGATGTGTGGAGATGT | 1408 | /5Phos/TCCCGTGGAGATGTGTGGAGATGT | 2176 | /5Phos/GTTGACATCTCCACACATCTCCAC |
| 641 | GTGGTGCAACGTGGTGCAAC | 1409 | /5Phos/TCCCGTGGTGCAACGTGGTGCAAC | 2177 | /5Phos/GTTGGTTGCACCACGTTGCACCAC |
| 642 | GTGTCGTTAAGTGTCGTTAA | 1410 | /5Phos/TCCCGTGTCGTTAAGTGTCGTTAA | 2178 | /5Phos/GTTGTTAACGACACTTAACGACAC |
| 643 | GTGTCTCAATGTGTCTCAAT | 1411 | /5Phos/TCCCGTGTCTCAATGTGTCTCAAT | 2179 | /5Phos/GTTGATTGAGACACATTGAGACAC |
| 644 | GTGTGATGACGTGTGATGAC | 1412 | /5Phos/TCCCGTGTGATGACGTGTGATGAC | 2180 | /5Phos/GTTGGTCATCACACGTCATCACAC |
| 645 | GTTAGATCGCGTTAGATCGC | 1413 | /5Phos/TCCCGTTAGATCGCGTTAGATCGC | 2181 | /5Phos/GTTGGCGATCTAACGCGATCTAAC |
| 646 | TAAGCCGATATAAGCCGATA | 1414 | /5Phos/TCCCTAAGCCGATATAAGCCGATA | 2182 | /5Phos/GTTGTATCGGCTTATATCGGCTTA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 647 | TAAGGACACCTAAGGACACC | 1415 | /5Phos/TCCCTAAGGACACCTAAGGACACC | 2183 | /5Phos/GTTGGGTGTCCTTAGGTGTCCTTA |
| 648 | TAAGGCCAAGTAAGGCCAAG | 1416 | /5Phos/TCCCTAAGGCCAAGTAAGGCCAAG | 2184 | /5Phos/GTTGCTTGGCCTTACTTGGCCTTA |
| 649 | TAATAGCGAGTAATAGCGAG | 1417 | /5Phos/TCCCTAATAGCGAGTAATAGCGAG | 2185 | /5Phos/GTTGCTCGCTATTACTCGCTATTA |
| 650 | TAATGGCCGGTAATGGCCGG | 1418 | /5Phos/TCCCTAATGGCCGGTAATGGCCGG | 2186 | /5Phos/GTTGCCGGCCATTACCGGCCATTA |
| 651 | TACCATTGGATACCATTGGA | 1419 | /5Phos/TCCCTACCATTGGATACCATTGGA | 2187 | /5Phos/GTTGTCCAATGGTATCCAATGGTA |
| 652 | TACGACCACCTACGACCACC | 1420 | /5Phos/TCCCTACGACCACCTACGACCACC | 2188 | /5Phos/GTTGGGTGGTCGTAGGTGGTCGTA |
| 653 | TACGACCTTATACGACCTTA | 1421 | /5Phos/TCCCTACGACCTTATACGACCTTA | 2189 | /5Phos/GTTGTAAGGTCGTATAAGGTCGTA |
| 654 | TACGTGATTCTACGTGATTC | 1422 | /5Phos/TCCCTACGTGATTCTACGTGATTC | 2190 | /5Phos/GTTGGAATCACGTAGAATCACGTA |
| 655 | TACTAGTCAGTACTAGTCAG | 1423 | /5Phos/TCCCTACTAGTCAGTACTAGTCAG | 2191 | /5Phos/GTTGCTGACTAGTACTGACTAGTA |
| 656 | TACTGACAAGTACTGACAAG | 1424 | /5Phos/TCCCTACTGACAAGTACTGACAAG | 2192 | /5Phos/GTTGCTTGTCAGTACTTGTCAGTA |
| 657 | TACTGCTGGCTACTGCTGGC | 1425 | /5Phos/TCCCTACTGCTGGCTACTGCTGGC | 2193 | /5Phos/GTTGGCCAGCAGTAGCCAGCAGTA |
| 658 | TAGACCGTAATAGACCGTAA | 1426 | /5Phos/TCCCTAGACCGTAATAGACCGTAA | 2194 | /5Phos/GTTGTTACGGTCTATTACGGTCTA |
| 659 | TAGACGAAGATAGACGAAGA | 1427 | /5Phos/TCCCTAGACGAAGATAGACGAAGA | 2195 | /5Phos/GTTGTCTTCGTCTATCTTCGTCTA |
| 660 | TAGCCTAGCCTAGCCTAGCC | 1428 | /5Phos/TCCCTAGCCTAGCCTAGCCTAGCC | 2196 | /5Phos/GTTGGGCTAGGCTAGGCTAGGCTA |
| 661 | TAGCGAATTCTAGCGAATTC | 1429 | /5Phos/TCCCTAGCGAATTCTAGCGAATTC | 2197 | /5Phos/GTTGGAATTCGCTAGAATTCGCTA |
| 662 | TAGCTGCCACTAGCTGCCAC | 1430 | /5Phos/TCCCTAGCTGCCACTAGCTGCCAC | 2198 | /5Phos/GTTGGTGGCAGCTAGTGGCAGCTA |
| 663 | TAGGTAGGCATAGGTAGGCA | 1431 | /5Phos/TCCCTAGGTAGGCATAGGTAGGCA | 2199 | /5Phos/GTTGTGCCTACCTATGCCTACCTA |
| 664 | TAGTCGTTACTAGTCGTTAC | 1432 | /5Phos/TCCCTAGTCGTTACTAGTCGTTAC | 2200 | /5Phos/GTTGGTAACGACTAGTAACGACTA |
| 665 | TAGTGCGAAGTAGTGCGAAG | 1433 | /5Phos/TCCCTAGTGCGAAGTAGTGCGAAG | 2201 | /5Phos/GTTGCTTCGCACTACTTCGCACTA |
| 666 | TAGTGGACGCTAGTGGACGC | 1434 | /5Phos/TCCCTAGTGGACGCTAGTGGACGC | 2202 | /5Phos/GTTGGCGTCCACTAGCGTCCACTA |
| 667 | TATAACGGTGTATAACGGTG | 1435 | /5Phos/TCCCTATAACGGTGTATAACGGTG | 2203 | /5Phos/GTTGCACCGTTATACACCGTTATA |
| 668 | TATAGAACCGTATAGAACCG | 1436 | /5Phos/TCCCTATAGAACCGTATAGAACCG | 2204 | /5Phos/GTTGCGGTTCTATACGGTTCTATA |
| 669 | TATCCGAAGGTATCCGAAGG | 1437 | /5Phos/TCCCTATCCGAAGGTATCCGAAGG | 2205 | /5Phos/GTTGCCTTCGGATACCTTCGGATA |
| 670 | TATCGGAGCCTATCGGAGCC | 1438 | /5Phos/TCCCTATCGGAGCCTATCGGAGCC | 2206 | /5Phos/GTTGGGCTCCGATAGGCTCCGATA |
| 671 | TATCGGCCTGTATCGGCCTG | 1439 | /5Phos/TCCCTATCGGCCTGTATCGGCCTG | 2207 | /5Phos/GTTGCAGGCCGATACAGGCCGATA |
| 672 | TATCGTCGGCTATCGTCGGC | 1440 | /5Phos/TCCCTATCGTCGGCTATCGTCGGC | 2208 | /5Phos/GTTGGCCGACGATAGCCGACGATA |
| 673 | TATGCGCCACTATGCGCCAC | 1441 | /5Phos/TCCCTATGCGCCACTATGCGCCAC | 2209 | /5Phos/GTTGGTGGCGCATAGTGGCGCATA |
| 674 | TATGGCCGTCTATGGCCGTC | 1442 | /5Phos/TCCCTATGGCCGTCTATGGCCGTC | 2210 | /5Phos/GTTGGACGGCCATAGACGGCCATA |
| 675 | TATTCTTCCGTATTCTTCCG | 1443 | /5Phos/TCCCTATTCTTCCGTATTCTTCCG | 2211 | /5Phos/GTTGCGGAAGAATACGGAAGAATA |
| 676 | TCAAGCAACGTCAAGCAACG | 1444 | /5Phos/TCCCTCAAGCAACGTCAAGCAACG | 2212 | /5Phos/GTTGCGTTGCTTGACGTTGCTTGA |
| 677 | TCAAGCAGTCTCAAGCAGTC | 1445 | /5Phos/TCCCTCAAGCAGTCTCAAGCAGTC | 2213 | /5Phos/GTTGGACTGCTTGAGACTGCTTGA |
| 678 | TCAAGTCCGATCAAGTCCGA | 1446 | /5Phos/TCCCTCAAGTCCGATCAAGTCCGA | 2214 | /5Phos/GTTGTCGGACTTGATCGGACTTGA |
| 679 | TCAATCGAGATCAATCGAGA | 1447 | /5Phos/TCCCTCAATCGAGATCAATCGAGA | 2215 | /5Phos/GTTGTCTCGATTGATCTCGATTGA |
| 680 | TCAATGTCGATCAATGTCGA | 1448 | /5Phos/TCCCTCAATGTCGATCAATGTCGA | 2216 | /5Phos/GTTGTCGACATTGATCGACATTGA |
| 681 | TCACTGAGGCTCACTGAGGC | 1449 | /5Phos/TCCCTCACTGAGGCTCACTGAGGC | 2217 | /5Phos/GTTGGCCTCAGTGAGCCTCAGTGA |
| 682 | TCAGCGAGACTCAGCGAGAC | 1450 | /5Phos/TCCCTCAGCGAGACTCAGCGAGAC | 2218 | /5Phos/GTTGGTCTCGCTGAGTCTCGCTGA |
| 683 | TCAGGAGGAATCAGGAGGAA | 1451 | /5Phos/TCCCTCAGGAGGAATCAGGAGGAA | 2219 | /5Phos/GTTGTTCCTCCTGATTCCTCCTGA |
| 684 | TCAGGCACAGTCAGGCACAG | 1452 | /5Phos/TCCCTCAGGCACAGTCAGGCACAG | 2220 | /5Phos/GTTGCTGTGCCTGACTGTGCCTGA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 685 | TCAGGCTTCCTCAGGCTTCC | 1453 | /5Phos/TCCCTCAGGCTTCCTCAGGCTTCC | 2221 | /5Phos/GTTGGGAAGCCTGAGGAAGCCTGA |
| 686 | TCCACACTCGTCCACACTCG | 1454 | /5Phos/TCCCTCCACACTCGTCCACACTCG | 2222 | /5Phos/GTTGCGAGTGTGGACGAGTGTGGA |
| 687 | TCCACAGCGATCCACAGCGA | 1455 | /5Phos/TCCCTCCACAGCGATCCACAGCGA | 2223 | /5Phos/GTTGTCGCTGTGGATCGCTGTGGA |
| 688 | TCCAGCTGCATCCAGCTGCA | 1456 | /5Phos/TCCCTCCAGCTGCATCCAGCTGCA | 2224 | /5Phos/GTTGTGCAGCTGGATGCAGCTGGA |
| 689 | TCCATAATCCTCCATAATCC | 1457 | /5Phos/TCCCTCCATAATCCTCCATAATCC | 2225 | /5Phos/GTTGGGATTATGGAGGATTATGGA |
| 690 | TCCGGACCAATCCGGACCAA | 1458 | /5Phos/TCCCTCCGGACCAATCCGGACCAA | 2226 | /5Phos/GTTGTTGGTCCGGATTGGTCCGGA |
| 691 | TCCGTAACGGTCCGTAACGG | 1459 | /5Phos/TCCCTCCGTAACGGTCCGTAACGG | 2227 | /5Phos/GTTGCCGTTACGGACCGTTACGGA |
| 692 | TCCGTAGGTCTCCGTAGGTC | 1460 | /5Phos/TCCCTCCGTAGGTCTCCGTAGGTC | 2228 | /5Phos/GTTGGACCTACGGAGACCTACGGA |
| 693 | TCCGTCCAAGTCCGTCCAAG | 1461 | /5Phos/TCCCTCCGTCCAAGTCCGTCCAAG | 2229 | /5Phos/GTTGCTTGGACGGACTTGGACGGA |
| 694 | TCCTGAACCGTCCTGAACCG | 1462 | /5Phos/TCCCTCCTGAACCGTCCTGAACCG | 2230 | /5Phos/GTTGCGGTTCAGGACGGTTCAGGA |
| 695 | TCCTGGCATGTCCTGGCATG | 1463 | /5Phos/TCCCTCCTGGCATGTCCTGGCATG | 2231 | /5Phos/GTTGCATGCCAGGACATGCCAGGA |
| 696 | TCGCGCTACATCGCGCTACA | 1464 | /5Phos/TCCCTCGCGCTACATCGCGCTACA | 2232 | /5Phos/GTTGTGTAGCGCGATGTAGCGCGA |
| 697 | TCGGTTACCATCGGTTACCA | 1465 | /5Phos/TCCCTCGGTTACCATCGGTTACCA | 2233 | /5Phos/GTTGTGGTAACCGATGGTAACCGA |
| 698 | TCGTCCGTCATCGTCCGTCA | 6146 | /5Phos/TCCCTCGTCCGTCATCGTCCGTCA | 2234 | /5Phos/GTTGTGACGGACGATGACGGACGA |
| 699 | TCGTCCTCAGTCGTCCTCAG | 1467 | /5Phos/TCCCTCGTCCTCAGTCGTCCTCAG | 2235 | /5Phos/GTTGCTGAGGACGACTGAGGACGA |
| 700 | TCTACCGCTCTCTACCGCTC | 1468 | /5Phos/TCCCTCTACCGCTCTCTACCGCTC | 2236 | /5Phos/GTTGGAGCGGTAGAGAGCGGTAGA |
| 701 | TCTAGCTCGGTCTAGCTCGG | 1469 | /5Phos/TCCCTCTAGCTCGGTCTAGCTCGG | 2237 | /5Phos/GTTGCCGAGCTAGACCGAGCTAGA |
| 702 | TCTCGGCTGATCTCGGCTGA | 1470 | /5Phos/TCCCTCTCGGCTGATCTCGGCTGA | 2238 | /5Phos/GTTGTCAGCCGAGATCAGCCGAGA |
| 703 | TCTCGGTCAGTCTCGGTCAG | 1471 | /5Phos/TCCCTCTCGGTCAGTCTCGGTCAG | 2239 | /5Phos/GTTGCTGACCGAGACTGACCGAGA |
| 704 | TCTCTAGATCTCTCTAGATC | 1472 | /5Phos/TCCCTCTCTAGATCTCTCTAGATC | 2240 | /5Phos/GTTGGATCTAGAGAGATCTAGAGA |
| 705 | TCTGACCGCATCTGACCGCA | 1473 | /5Phos/TCCCTCTGACCGCATCTGACCGCA | 2241 | /5Phos/GTTGTGCGGTCAGATGCGGTCAGA |
| 706 | TCTGGACAGATCTGGACAGA | 1474 | /5Phos/TCCCTCTGGACAGATCTGGACAGA | 2242 | /5Phos/GTTGTCTGTCCAGATCTGTCCAGA |
| 707 | TCTGGATAAGTCTGGATAAG | 1475 | /5Phos/TCCCTCTGGATAAGTCTGGATAAG | 2243 | /5Phos/GTTGCTTATCCAGACTTATCCAGA |
| 708 | TCTTACGGCCTCTTACGGCC | 1476 | /5Phos/TCCCTCTTACGGCCTCTTACGGCC | 2244 | /5Phos/GTTGGGCCGTAAGAGGCCGTAAGA |
| 709 | TCTTGCATACTCTTGCATAC | 1477 | /5Phos/TCCCTCTTGCATACTCTTGCATAC | 2245 | /5Phos/GTTGGTATGCAAGAGTATGCAAGA |
| 710 | TGAACTTGGATGAACTTGGA | 1478 | /5Phos/TCCCTGAACTTGGATGAACTTGGA | 2246 | /5Phos/GTTGTCCAAGTTCATCCAAGTTCA |
| 711 | TGACACAGCGTGACACAGCG | 1479 | /5Phos/TCCCTGACACAGCGTGACACAGCG | 2247 | /5Phos/GTTGCGCTGTGTCACGCTGTGTCA |
| 712 | TGACAGGTCCTGACAGGTCC | 1480 | /5Phos/TCCCTGACAGGTCCTGACAGGTCC | 2248 | /5Phos/GTTGGGACCTGTCAGGACCTGTCA |
| 713 | TGACCTTCCGTGACCTTCCG | 1481 | /5Phos/TCCCTGACCTTCCGTGACCTTCCG | 2249 | /5Phos/GTTGCGGAAGGTCACGGAAGGTCA |
| 714 | TGACGTCGGATGACGTCGGA | 1482 | /5Phos/TCCCTGACGTCGGATGACGTCGGA | 2250 | /5Phos/GTTGTCCGACGTCATCCGACGTCA |
| 715 | TGACTATCTCTGACTATCTC | 1483 | /5Phos/TCCCTGACTATCTCTGACTATCTC | 2251 | /5Phos/GTTGGAGATAGTCAGAGATAGTCA |
| 716 | TGACTCCAGGTGACTCCAGG | 1484 | /5Phos/TCCCTGACTCCAGGTGACTCCAGG | 2252 | /5Phos/GTTGCCTGGAGTCACCTGGAGTCA |
| 717 | TGAGAGCAGGTGAGAGCAGG | 1485 | /5Phos/TCCCTGAGAGCAGGTGAGAGCAGG | 2253 | /5Phos/GTTGCCTGCTCTCACCTGCTCTCA |
| 718 | TGAGCCTCCATGAGCCTCCA | 1486 | /5Phos/TCCCTGAGCCTCCATGAGCCTCCA | 2254 | /5Phos/GTTGTGGAGGCTCATGGAGGCTCA |
| 719 | TGAGTATGGATGAGTATGGA | 1487 | /5Phos/TCCCTGAGTATGGATGAGTATGGA | 2255 | /5Phos/GTTGTCCATACTCATCCATACTCA |
| 720 | TGCAACATACTGCAACATAC | 1488 | /5Phos/TCCCTGCAACATACTGCAACATAC | 2256 | /5Phos/GTTGGTATGTTGCAGTATGTTGCA |
| 721 | TGCGCTGTAGTGCGCTGTAG | 1489 | /5Phos/TCCCTGCGCTGTAGTGCGCTGTAG | 2257 | /5Phos/GTTGCTACAGCGCACTACAGCGCA |
| 722 | TGCTAACCGGTGCTAACCGG | 1490 | /5Phos/TCCCTGCTAACCGGTGCTAACCGG | 2258 | /5Phos/GTTGCCGGTTAGCACCGGTTAGCA |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 723 | TGCTCCACTGTGCTCCACTG | 1491 | /5Phos/TCCCTGCTCCACTGTGCTCCACTG | 2259 | /5Phos/GTTGCAGTGGAGCACAGTGGAGCA |
| 724 | TGGAAGGAGCTGGAAGGAGC | 1492 | /5Phos/TCCCTGGAAGGAGCTGGAAGGAGC | 2260 | /5Phos/GTTGGCTCCTTCCAGCTCCTTCCA |
| 725 | TGGCAGTGACTGGCAGTGAC | 1493 | /5Phos/TCCCTGGCAGTGACTGGCAGTGAC | 2261 | /5Phos/GTTGGTCACTGCCAGTCACTGCCA |
| 726 | TGGCATCAGCTGGCATCAGC | 1494 | /5Phos/TCCCTGGCATCAGCTGGCATCAGC | 2262 | /5Phos/GTTGGCTGATGCCAGCTGATGCCA |
| 727 | TGGCCTTATATGGCCTTATA | 1495 | /5Phos/TCCCTGGCCTTATATGGCCTTATA | 2263 | /5Phos/GTTGTATAAGGCCATATAAGGCCA |
| 728 | TGGCGAAGCATGGCGAAGCA | 1496 | /5Phos/TCCCTGGCGAAGCATGGCGAAGCA | 2264 | /5Phos/GTTGTGCTTCGCCATGCTTCGCCA |
| 729 | TGGCTTAAGATGGCTTAAGA | 1497 | /5Phos/TCCCTGGCTTAAGATGGCTTAAGA | 2265 | /5Phos/GTTGTCTTAAGCCATCTTAAGCCA |
| 730 | TGGTCAGCTCTGGTCAGCTC | 1498 | /5Phos/TCCCTGGTCAGCTCTGGTCAGCTC | 2266 | /5Phos/GTTGGAGCTGACCAGAGCTGACCA |
| 731 | TGGTTCCAACTGGTTCCAAC | 1499 | /5Phos/TCCCTGGTTCCAACTGGTTCCAAC | 2267 | /5Phos/GTTGGTTGGAACCAGTTGGAACCA |
| 732 | TGGTTGGTAATGGTTGGTAA | 1500 | /5Phos/TCCCTGGTTGGTAATGGTTGGTAA | 2268 | /5Phos/GTTGTTACCAACCATTACCAACCA |
| 733 | TGTACGCGCATGTACGCGCA | 1501 | /5Phos/TCCCTGTACGCGCATGTACGCGCA | 2269 | /5Phos/GTTGTGCGCGTACATGCGCGTACA |
| 734 | TGTACGCTGGTGTACGCTGG | 1502 | /5Phos/TCCCTGTACGCTGGTGTACGCTGG | 2270 | /5Phos/GTTGCCAGCGTACACCAGCGTACA |
| 735 | TGTAGCATTGTGTAGCATTG | 1503 | /5Phos/TCCCTGTAGCATTGTGTAGCATTG | 2271 | /5Phos/GTTGCAATGCTACACAATGCTACA |
| 736 | TGTAGTGCCGTGTAGTGCCG | 1504 | /5Phos/TCCCTGTAGTGCCGTGTAGTGCCG | 2272 | /5Phos/GTTGCGGCACTACACGGCACTACA |
| 737 | TGTGAATCTGTGTGAATCTG | 1505 | /5Phos/TCCCTGTGAATCTGTGTGAATCTG | 2273 | /5Phos/GTTGCAGATTCACACAGATTCACA |
| 738 | TGTTCCGTGGTGTTCCGTGG | 1506 | /5Phos/TCCCTGTTCCGTGGTGTTCCGTGG | 2274 | /5Phos/GTTGCCACGGAACACCACGGAACA |
| 739 | TTAGCGCGTGTTAGCGCGTG | 1507 | /5Phos/TCCCTTAGCGCGTGTTAGCGCGTG | 2275 | /5Phos/GTTGCACGCGCTAACACGCGCTAA |
| 740 | TTAGTTGGACTTAGTTGGAC | 1508 | /5Phos/TCCCTTAGTTGGACTTAGTTGGAC | 2276 | /5Phos/GTTGGTCCAACTAAGTCCAACTAA |
| 741 | TTCCAACTTCTTCCAACTTC | 1509 | /5Phos/TCCCTTCCAACTTCTTCCAACTTC | 2277 | /5Phos/GTTGGAAGTTGGAAGAAGTTGGAA |
| 742 | TTCCGTCAGGTTCCGTCAGG | 1510 | /5Phos/TCCCTTCCGTCAGGTTCCGTCAGG | 2278 | /5Phos/GTTGCCTGACGGAACCTGACGGAA |
| 743 | TTCCTCACCGTTCCTCACCG | 1511 | /5Phos/TCCCTTCCTCACCGTTCCTCACCG | 2279 | /5Phos/GTTGCGGTGAGGAACGGTGAGGAA |
| 744 | TTCCTCCGACTTCCTCCGAC | 1512 | /5Phos/TCCCTTCCTCCGACTTCCTCCGAC | 2280 | /5Phos/GTTGGTCGGAGGAAGTCGGAGGAA |
| 745 | TTCGACCTGGTTCGACCTGG | 1513 | /5Phos/TCCCTTCGACCTGGTTCGACCTGG | 2281 | /5Phos/GTTGCCAGGTCGAACCAGGTCGAA |
| 746 | TTCGCGTGGATTCGCGTGGA | 1514 | /5Phos/TCCCTTCGCGTGGATTCGCGTGGA | 2282 | /5Phos/GTTGTCCACGCGAATCCACGCGAA |
| 747 | TTCGGAAGCGTTCGGAAGCG | 1515 | /5Phos/TCCCTTCGGAAGCGTTCGGAAGCG | 2283 | /5Phos/GTTGCGCTTCCGAACGCTTCCGAA |
| 748 | TTCTCGATTGTTCTCGATTG | 1516 | /5Phos/TCCCTTCTCGATTGTTCTCGATTG | 2284 | /5Phos/GTTGCAATCGAGAACAATCGAGAA |
| 749 | TTCTCTCTAGTTCTCTCTAG | 1517 | /5Phos/TCCCTTCTCTCTAGTTCTCTCTAG | 2285 | /5Phos/GTTGCTAGAGAACTAGAGAGAA |
| 750 | TTCTTGCGCGTTCTTGCGCG | 1518 | /5Phos/TCCCTTCTTGCGCGTTCTTGCGCG | 2286 | /5Phos/GTTGCGCGCAAGAACGCGCAAGAA |
| 751 | TTGAGGTCGGTTGAGGTCGG | 1519 | /5Phos/TCCCTTGAGGTCGGTTGAGGTCGG | 2287 | /5Phos/GTTGCCGACCTCAACCGACCTCAA |
| 752 | TTGCACACGCTTGCACACGC | 1520 | /5Phos/TCCCTTGCACACGCTTGCACACGC | 2288 | /5Phos/GTTGGCGTGTGCAAGCGTGTGCAA |
| 753 | TTGCGCTCTGTTGCGCTCTG | 1521 | /5Phos/TCCCTTGCGCTCTGTTGCGCTCTG | 2289 | /5Phos/GTTGCAGAGCGCAACAGAGCGCAA |
| 754 | TTGCTGCAGCTTGCTGCAGC | 1522 | /5Phos/TCCCTTGCTGCAGCTTGCTGCAGC | 2290 | /5Phos/GTTGGCTGCAGCAAGCTGCAGCAA |
| 755 | TTGGCGTCTGTTGGCGTCTG | 1523 | /5Phos/TCCCTTGGCGTCTGTTGGCGTCTG | 2291 | /5Phos/GTTGCAGACGCCAACAGACGCCAA |
| 756 | TTGGTCCTTCTTGGTCCTTC | 1524 | /5Phos/TCCCTTGGTCCTTCTTGGTCCTTC | 2292 | /5Phos/GTTGGAAGGACCAAGAAGGACCAA |
| 757 | TTGTCGAGAGTTGTCGAGAG | 1525 | /5Phos/TCCCTTGTCGAGAGTTGTCGAGAG | 2293 | /5Phos/GTTGCTCTCGACAACTCTCGACAA |
| 758 | TTGTCTGTACTTGTCTGTAC | 1526 | /5Phos/TCCCTTGTCTGTACTTGTCTGTAC | 2294 | /5Phos/GTTGGTACAGACAAGTACAGACAA |
| 759 | TTGTTCTCTCTTGTTCTCTC | 1527 | /5Phos/TCCCTTGTTCTCTCTTGTTCTCTC | 2295 | /5Phos/GTTGGAGAGAACAAGAGAGAACAA |
| 760 | AACACACGTTAACACACGTT | 1528 | /5Phos/TCCCAACACACGTTAACACACGTT | 2296 | /5Phos/GTTGAACGTGTGTTAACGTGTGTT |

TABLE 1-continued

| SEQ ID NO: | Tag | SEQ ID NO: | Full Oligo Sequence (Top) | SEQ ID NO: | Full Oligo Sequence (Bot) |
|---|---|---|---|---|---|
| 761 | AACATCGAGTAACATCGAGT | 1529 | /5Phos/TCCCAACATCGAGTAACATCGAGT | 2297 | /5Phos/GTTGACTCGATGTTACTCGATGTT |
| 762 | AACCGAGGACAACCGAGGAC | 1530 | /5Phos/TCCCAACCGAGGACAACCGAGGAC | 2298 | /5Phos/GTTGGTCCTCGGTTGTCCTCGGTT |
| 763 | AACCTAGTAGAACCTAGTAG | 1531 | /5Phos/TCCCAACCTAGTAGAACCTAGTAG | 2299 | /5Phos/GTTGCTACTAGGTTCTACTAGGTT |
| 764 | AACGCATACTAACGCATACT | 1532 | /5Phos/TCCCAACGCATACTAACGCATACT | 2300 | /5Phos/GTTGAGTATGCGTTAGTATGCGTT |
| 765 | AACTAACCTCAACTAACCTC | 1533 | /5Phos/TCCCAACTAACCTCAACTAACCTC | 2301 | /5Phos/GTTGGAGGTTAGTTGAGGTTAGTT |
| 766 | AACTAAGGAGAACTAAGGAG | 1534 | /5Phos/TCCCAACTAAGGAGAACTAAGGAG | 2302 | /5Phos/GTTGCTCCTTAGTTCTCCTTAGTT |
| 767 | AACTCGTTCTAACTCGTTCT | 1535 | /5Phos/TCCCAACTCGTTCTAACTCGTTCT | 2303 | /5Phos/GTTGAGAACGAGTTAGAACGAGTT |
| 768 | AACTGCCGCTAACTGCCGCT | 1536 | /5Phos/TCCCAACTGCCGCTAACTGCCGCT | 2304 | /5Phos/GTTGAGCGGCAGTTAGCGGCAGTT |

Each unique label may comprise two or more detectable oligonucleotide tags. The two or more tags may be three or more tags, four or more tags, or five or more tags. In some embodiments, a unique label may comprise 2, 3, 4, 5, 6, 7, 8, 9, 10, 15, 20, 30, 40, 50, 100 or more detectable tags.

The tags are typically bound to each other, typically in a directional manner. Methods for sequentially attaching nucleic acids such as oligonucleotides to each other are known in the art and include, but are not limited to, ligation and polymerization, or a combination of both (see, e.g., Green and Sambrook. Molecular Cloning: A Laboratory Manual, Fourth Edition, 2012). Ligation reactions include blunt end ligation and cohesive overhang ligation. In some instances, ligation may comprise both blunt end and cohesive overhang ligation. A "cohesive overhang" (also referred to as a "cohesive end" or an "overhang") is a single stranded end sequence (attached to a double stranded sequence) capable of binding to another single stranded sequence thereby forming a double stranded sequence. A cohesive overhang may be generated by a polymerase, a restriction endonuclease, a combination of a polymerase and a restriction endonuclease, or a Uracil-Specific Excision Reagent (USER™) enzyme (New England BioLabs Inc., Ipswich, Mass.) or a combination of a Uracil DNA glycosylase enzyme and a DNA. glycosylase-lyase Exonuclease VIII enzyme. A "cohesive overhang" may be a thymidine Polymerization reactions include enzyme-mediated polymerization such as a polymerase-mediated fill-reaction.

Methods for detecting and analyzing unique labels are known in the art. In some embodiments, detection may comprise determining the presence, number, and/or order of detectable tags that may comprise a unique label. For example, if the unique label may comprise detectable moieties, as described herein, fluorometry, mass spectrometry, or other detection methodology can be used for detection. In another example, if the unique label may comprise unique nucleotide sequences, a sequencing methodology can be used for detection. If the unique label may comprise both unique sequences and detectable moieties, a combination of detection methods may be appropriate, e.g., fluorometry and a sequencing reaction.

Methods of sequencing oligonucleotides and nucleic acids are well known in the art (see, e.g., WO93/23564, WO98/28440 and WO98/13523; U.S. Pat. Nos. 5,525,464; 5,202,231; 5,695,940; 4,971,903; 5,902,723; 5,795,782; 5,547,839 and 5,403,708; Sanger et al., Proc. Natl. Acad. Sci. USA 74:5463 (1977); Drmanac et al., Genomics 4:114 (1989); Koster et al., Nature Biotechnology 14:1123 (1996); Hyman, Anal. Biochem. 174:423 (1988); Rosenthal, International Patent Application Publication 761107 (1989); Metzker et al., Nucl. Acids Res. 22:4259 (1994); Jones, Biotechniques 22:938 (1997); Ronaghi et al., Anal. Biochem. 242:84 (1996); Ronaghi et al., Science 281:363 (1998); Nyren et al., Anal. Biochem. 151:504 (1985); Canard and Arzumanov, Gene 11:1 (1994); Dyatkina and Arzumanov, Nucleic Acids Symp Ser 18:117 (1987); Johnson et al., Anal. Biochem. 136:192 (1984); and Elgen and Rigler, Proc. Natl. Acad. Sci. USA 91(13):5740 (1994), all of which are expressly incorporated by reference)

Methods of detecting moieties, such as but not limited to fluorophores, are known in the art. (see, e.g., WO199641011; WO2000006770; WO2002072892; WO2007123744; Leroi V. DeSouza, K. W. Michael Siu, Ronald E. Pearlman. Mass Spectrometry: An Outsourcing Guide. Current Protocols Essential Laboratory Techniques. 2:12.2.1-12.1.18. 2009; Daman, B. and Aebersold, R. Mass spectrometry and protein analysis. Science 312:212-217. 2006.; Current Protocols in Imaging and Microscopy, and Current Protocols in Cell Biology, the entirety of which are incorporated herein by reference). In some embodiments, fluorophores such as nanocrystal quantum dots can be used to dynamically create unique combinations of labels. Quantum dots are nanometer-sized particles which may be comprised of semiconductor material that, when excited with ultraviolet light, emit specific wavelengths of light depending on the size of the nanocrystal. The emission wavelength from a given quantum dot is narrow and symmetric, thus minimizing overlap with other wavelengths and facilitating the detection of discrete quantum dots in a mixed solution. Quantum dots can be coupled to various biomolecules including, but not limited to, proteins, nucleic acids and other small molecules. Such bioconjugated quantum dots can be used to deliver fluorophores to the target molecules by various methods including, but not limited to, nucleic acid ligation, oligonucleotide annealing and protein-ligand interaction. For example, quantum dots could be bioconjugated to short double stranded nucleic acid sequences that could then be ligated to the ends of DNA molecules or bioconjugated to specific nucleic acid sequences that could anneal (hybridize) to a target or targets of interest. Discrete populations of dsDNA-quantum dot conjugates could be prepared, physically separated into either well-plates or emulsion droplets and systematically added to the ends of DNA molecules as described above. Similarly, a solid-support particle (e.g., a bead) could be attached to the ends of a population of nucleic acids. The solid-support particle would be capable of capturing bioconjugated quantum dots through protein-ligand interactions. In any of these examples, quantum dots would be added to the target molecules in a controlled manner such that the maximum population of target molecules would not exceed the number of unique combinations that could be created by the number of quantum dots available. The same exponential relationship between the number of "tags" (i.e., quantum dots) and the iterations of tag addition applies here such that the maximum number of combinations is $X^Y$ where X is the number of quantum dots and Y is the number of iterations of tag addition. In any of these examples, standard methods for fluorescence detection including, but not limited to, fluorescence activated cell/particle sorting, hybridization to a fixed array of oligonucleotides, etc., could be used to detect the "signature" of a single molecule or population of molecules. In some embodiments, it may be desirable to analyze a large population of emulsion droplets to determine the unique emission wavelengths contained in a given droplet on a droplet-by-droplet basis.

Generation of Unique Labels

In some aspects, the invention provides methods for generating unique labels. The methods typically use a plurality of detectable tags to generate unique labels. in some embodiments, a unique label is produced by sequentially attaching two or more detectable oligonucleotide tags to each other. The detectable tags may be present or provided in a plurality of detectable tags. The same or a different plurality of tags may be used as the source of each detectable tag which may be comprised in a unique label. In other words, a plurality of tags may be subdivided into subsets and single subsets may be used as the source for each tag. This is exemplified in at least FIG. 1.

A plurality of tags may comprise 2, 3, 4, 5, 6, 7, 8, 9, 10, $10^2$, $10^3$, $10^4$, $10^5$, or $10^6$, or more tags. Typically, the tags within a plurality are unique relative to each other.

The methods of the invention allow an end user to generate a unique label for a plurality of agents using a number of tags that are less (and in some instances far less) than the number of agents to be labeled. The number of tags may be up to or about 10-fold, $10^2$-fold, $10^3$-fold, or $10^4$-fold less than the number of agents. The number of agents to be labeled will depend on the particular application. The invention contemplates uniquely labeling at least $10^3$, $10^4$, $10^5$, $10^6$, $10^7$, $10^8$, $10^9$, or $10^{10}$ or more agents. In some embodiments, the agent may comprise a plurality of nucleic acids. In some embodiments, the plurality of nucleic acids may comprise at least $10^3$, $10^4$, $10^5$, $10^6$, $10^7$, $10^8$, $10^9$, or $10^{10}$ nucleic acids.

In certain methods of the invention, agents, detectable tags, and resultant unique labels are all present in a contained volume and are thus physically separate from other agents, detectable tags, and resultant unique labels. In some instances, the contained volume is on the order of picoliters, nanoliters, or microliters. The contained volume may be a droplet such as an emulsion droplet, a well of a multiwall plate, a tube or other container.

In some embodiments a subset of the plurality of agents is present in the same container during attachment of a detectable label. In some embodiments, the plurality of agents is separated such that each agent in the plurality is in a separate container, e.g., a well of a multiwell plate.

In some embodiments, the process of pooling and subsequently separating the plurality of agents is performed n number of times, wherein n is the number of times required to generate $(m_1)(m_2)(m_3) \ldots (m_n)$ number of combinations of detectable oligonucleotide tags, wherein $(m_1)(m_2)(m_3) \ldots (m_n)$ number of combinations of detectable oligonucleotide tags is greater than the number of the plurality of agents.

The invention provides a method which may comprise (a) labeling two or more first subsets of agents with a detectable oligonucleotide tag to produce agents within a subset that are identically labeled relative to each other and uniquely labeled relative to agents in other subsets;

(b) combining two or more subsets of uniquely-labeled agents to form a pool of agents, wherein the pool may comprise two or more second subsets of agents that are distinct from the two or more first subsets of agents;

(c) identically labeling two or more second subsets of agents with a second detectable oligonucleotide tag to produce agents within a second subset that are uniquely labeled relative to agents in the same or different second subsets; and (d) repeating steps (b) and (c) until a number of unique labels is generated that exceeds the number of starting agents, wherein each unique label may comprise at least two detectable oligonucleotide tags.

The invention provides another method which may comprise (a) providing a pool of agents;

(b) separating the pool of agents into sub-pools of agents;

(c) labeling agents in each sub-pool of with one of $m_1$ unique detectable oligonucleotide tags thereby producing sub-pools of labeled agents, wherein agents in a sub-pool are identically labeled to each other;

(d) combining sub-pools of labeled agents to create a pool of labeled agents;

(e) separating the pool of labeled agents into second sub-pools of agents;

(f) repeating steps (c) to (e) n times to produce agents labeled with n unique detectable oligonucleotide tags, wherein the pool in (a) consists of a number of agents that is less than $(m_1)(m_2)(m_3) \ldots (m_n)$.

The invention provides another method which may comprise (a) providing a population of library droplets which may comprise agents, wherein each droplet may comprise an agent;

(b) fusing each individual library droplet with a single detectable oligonucleotide tag droplet from a plurality of $m_1$ detectable oligonucleotide tag droplets, each detectable oligonucleotide tag droplet which may comprise a plurality of identical detectable oligonucleotide tag;

(c) labeling the agent with the detectable oligonucleotide tag in a fused droplet;

(d) harvesting labeled agents from the fused droplets and generating another population of library droplets which may comprise labeled agents; and repeating steps (b) to (d) ii times to produce agents labeled with a unique label which may comprise n detectable oligonucleotides tags, wherein the n detectable oligonucleotide tags generate an $(m_1)(m_2)(m_3) \ldots (m_n)$ number of combinations that is greater than the number of starting agents.

The invention provides another method which may comprise (a) providing a population of library droplets which may comprise agents, wherein each droplet may comprise more than one agent;

(b) fusing each individual library droplet with a single detectable oligonucleotide tag droplet from a plurality of $m_1$ detectable oligonucleotide tag droplets, each detectable oligonucleotide tag droplet which may comprise a plurality of identical detectable oligonucleotide tag;

(c) labeling the more than one agents with the detectable oligonucleotide tag in a fused droplet;

(d) harvesting labeled agents from the fused droplets and generating another population of library droplets which may comprise labeled agents, wherein each droplet may comprise more than one agent; and (e) repeating steps (b) to (d) n times to produce agents labeled with a unique label which may comprise n detectable oligonucleotides tags, wherein the n detectable oligonucleotide tags generate an $(m_1)(m_2)(m_3) \ldots (m_n)$ number of combinations that is greater than the number of starting agents and optionally wherein the agents within the same droplet are labeled identically.

In some embodiments, the unique oligonucleotide label is attached to a solid support. In some embodiments, the solid support is a bead or polymer. In some embodiments, the fill-in reaction is a polymerase chain reaction.

In another embodiment, the method may comprise:

sequentially end-labeling nucleic acids in a plurality, at their 5' and 3' ends, with a random combination of n detectable oligonucleotide tags, wherein each end-labeled nucleic acid is (a) identically labeled at its 5' and 3' ends, and (b) uniquely labeled relative to other nucleic acids in the plurality, wherein each detectable oligonucleotide tags is randomly and independently selected from a number of detectable oligonucleotide tags that is less than the number of nucleic acids, and n is the number of oligonucleotides attached to an end of a nucleic acid.

In some embodiments, the further may comprise fragmenting end-labeled nucleic acids into at least a 5' fragment which may comprise the 5' end of the nucleic acid attached to the random combination of n detectable oligonucleotide tags and into a 3' fragment which may comprise the 3' end of the nucleic acid attached to the random combination of n detectable oligonucleotide tags. In some embodiments, the 5' and 3' fragments are about 10-1000 bases (base pairs) in length, or about 10-500 bases in length, or about 10-200 bases in length. In some embodiments, the method further may comprise sequencing the 5' and 3' fragments.

In another embodiment, the method may comprise:

sequencing a pair of genomic nucleic acid fragments, wherein the genomic nucleic acid fragments are attached to identical unique labels at one of their ends that indicates the genomic nucleic acid fragments were separated by a known distance in a genome prior to fragmentation.

In some embodiments, the pair of nucleic acid fragments were separated by greater than 10 kb in the genome prior to fragmentation. In another embodiment, the pair of nucleic acid fragments were separated by greater than 40 kb in the genome prior to fragmentation. In some embodiments, the method further may comprise generating the pair of genomic nucleic acid fragments by fragmenting nucleic acids which may comprise genomic sequence and identical non-genomic sequence at their 5' and 3' ends.

In another aspect, the invention provides compositions. In one embodiment, the composition may comprise:

a plurality of paired nucleic acid fragments attached to unique labels at one end, wherein paired nucleic acid fragments:

(a) share an identical unique label at one end that is unique in the plurality, and (b) were separated from each other in a genome by a known distance prior to fragmentation.

In some embodiments, paired nucleic acid fragments were separated by greater than 10 kb in the genome prior to fragmentation. In another embodiment, the paired nucleic acid fragments were separated by greater than 40 kb in the genome prior to fragmentation. In some embodiments, the composition is produced using any of the methods described herein.

Examples of nucleic acids include, but are not limited to, genomic DNA, cDNA, PCR products, mRNA, total RNA, plasmids, or fragments thereof. In some embodiments, the nucleic acids are genomic DNA, cDNA, PCR products, or fragments thereof. Nucleic acids can be fragmented using methods described herein.

In some embodiments, the nucleic acids are attached to a solid support. Examples of suitable solid supports include, but are not limited to, polymers, beads, glass, nanoparticles, hydrogels or peptides. In some embodiments, the solid support is a polymer or a bead. in some embodiments, the nucleic acids are attached to the solid support with a cleavable linker as described herein.

In some embodiments, the method further may comprise fragmenting uniquely end- labeled nucleic acids. Fragmenting of nucleic acids can be accomplished by methods described herein and those well-known in the art.

In one embodiment, the method may comprise sequencing a pair of genomic nucleic acid fragments, wherein the genomic nucleic acid fragments are attached to identical unique labels at one of their ends that indicates the genomic nucleic acid fragments were separated by a known distance in a genome prior to fragmentation. In some embodiments, the known distance is greater than 5, 10, 15, 20, 30, 40, 50, 100 kb or greater separation. Genomic nucleic acid fragments can come from any organismal genomic DNA, for example, human, mammalian, bacterial, fungal or plant genomic DNA. Genomic nucleic acid fragments can be generated by fragmentation methods known in the art (see, e.g., Green and Sambrook. Molecular Cloning: A Laboratory Manual, Fourth Edition, 2012). Examples of fragmentation include, but are not limited to, enzymatic (such as a nuclease), chemical (such as a DNA nicking agent) or mechanical (such as sonication) fragmentation. Fragmentation can be random, e.g., sequence and size unspecific, or ordered, e.g., sequence dependent and/or size-restricted. The fragments generated following label addition can be tailored to the limitations of the desired detection technology. For example, the fragments can be hundreds, thousands, millions or potentially billions of base pairs in length depending on the technology used to sequence the DNA.

Fragment Amplification

Figure 37A:
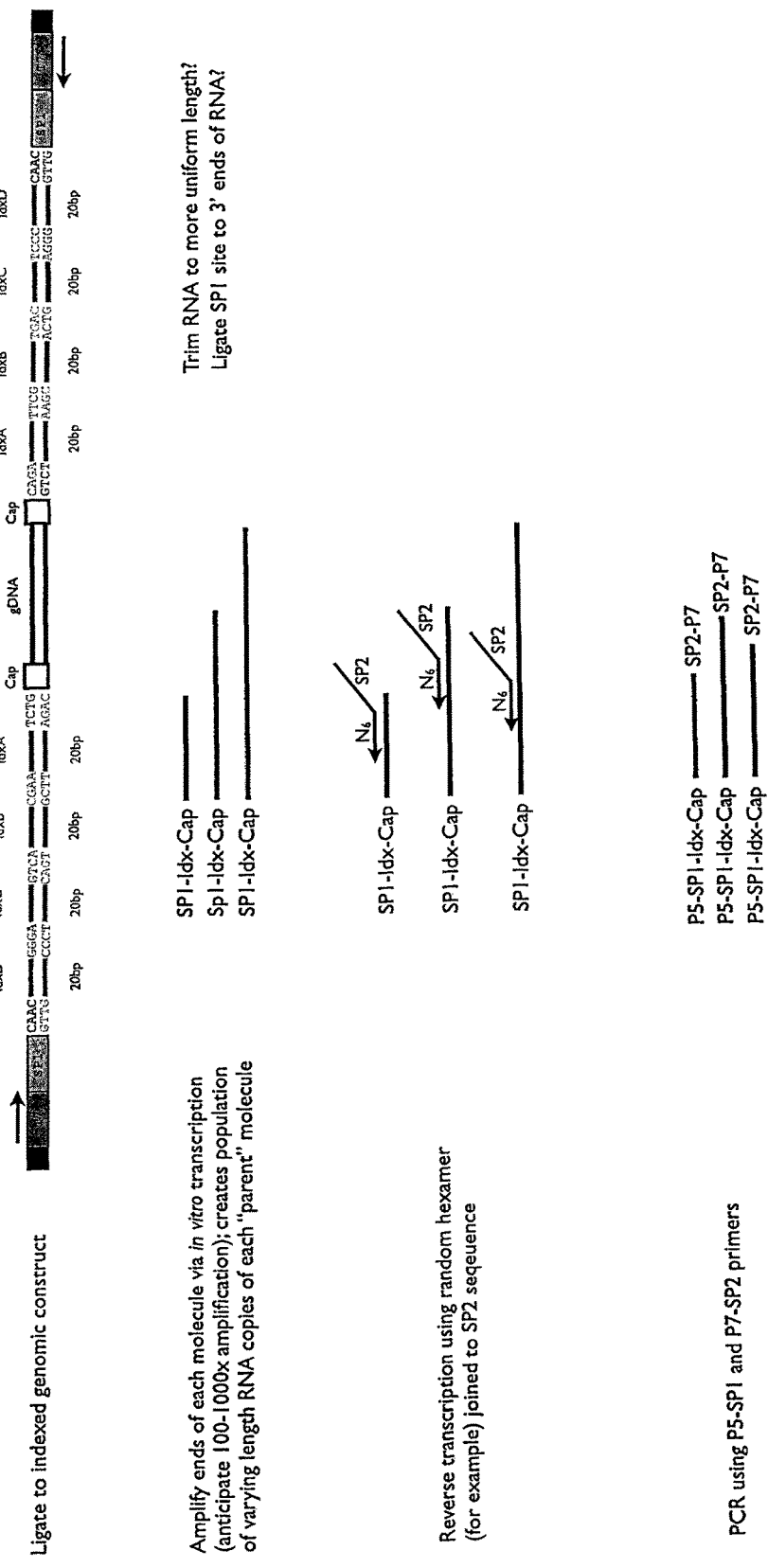
FIGS. 37a and 37b illustrate enrichment of ends via in vitro transcription.
Figure 37B:
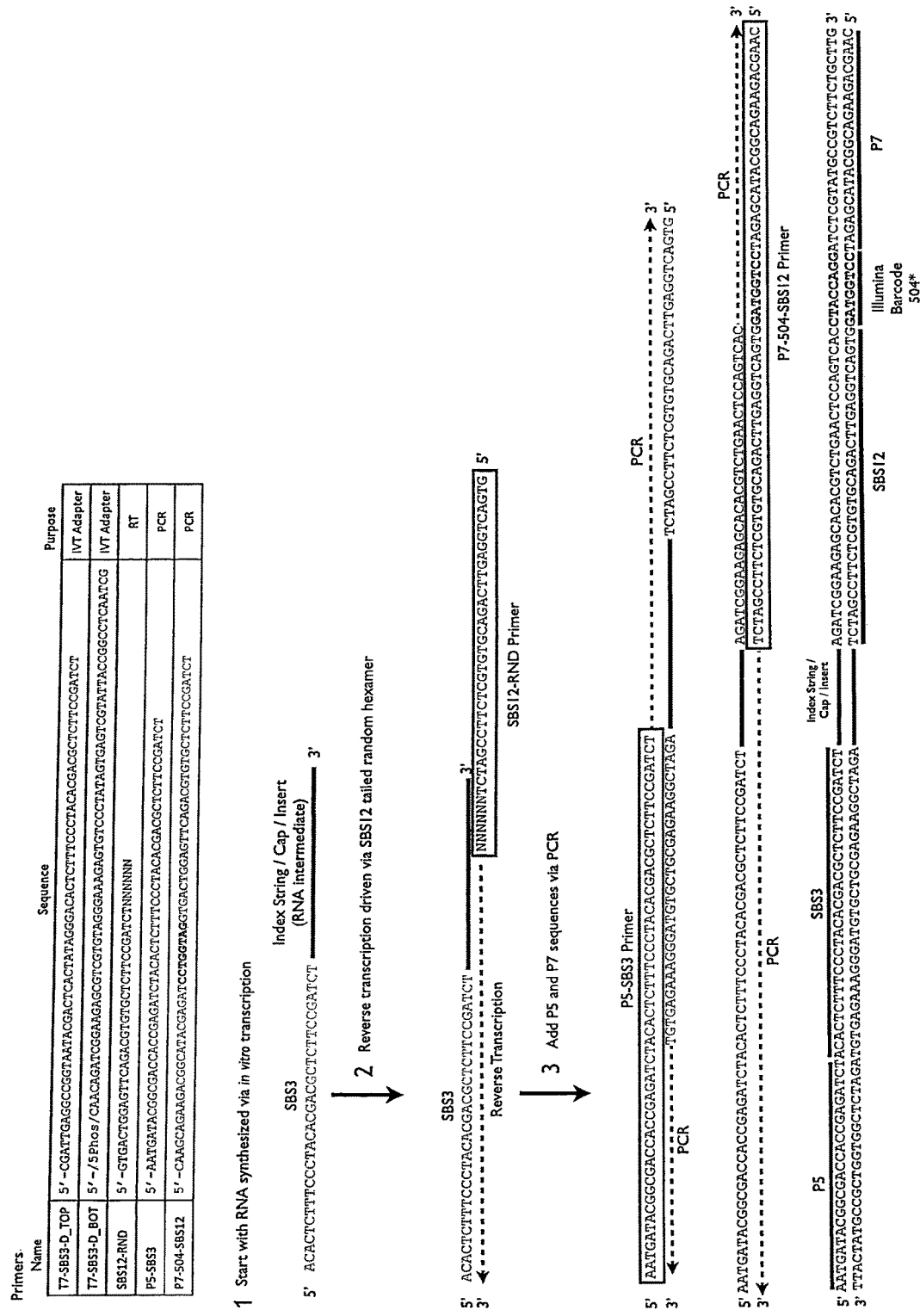
Figure 38:
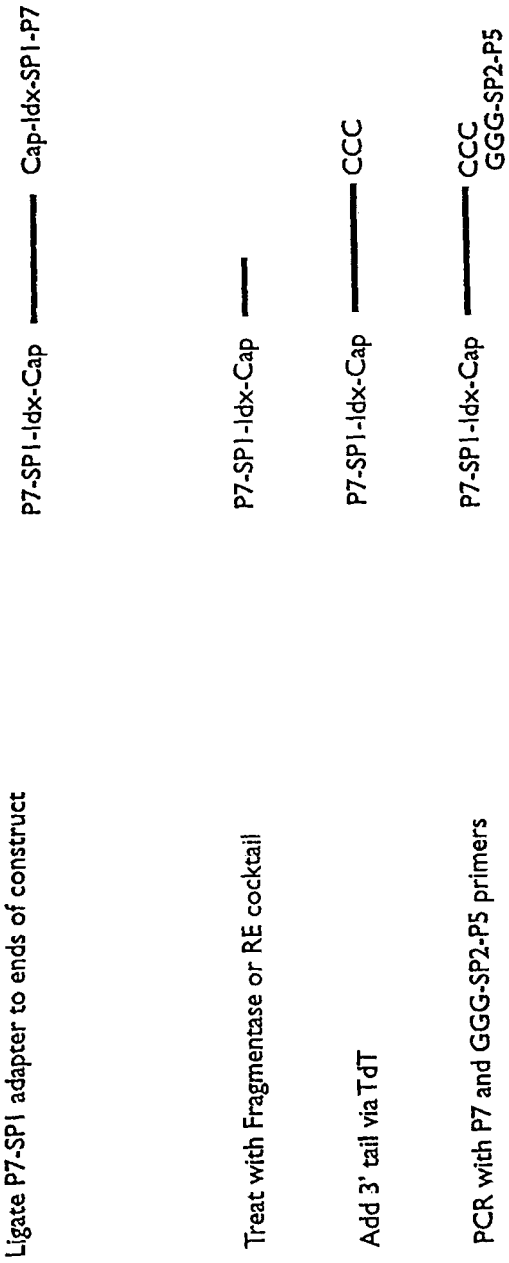
FIG. 38 shows amplification of ends via anchored PCR.

Fragments can be amplified to increase the number of read pairs properly mated via their unique index combination. Amplification methods can be used to maximize fragment end recovery. These methods utilize the fragment preparation and indexing techniques described above, but vary in their approach to recovering and amplifying fragment ends within the library construction process. In one embodiment, the amplification method involves transposome-based selection and amplification. This method is shown in FIG. 36 and described in the Examples below. In another embodiment, the amplification method involves enrichment of ends via in vitro transcription. This method is illustrated in FIGS. 37a and 37b and also described in the Examples below. In a further embodiment, the amplification method involves anchored PCR. FIG. 38 shows this method and is also exemplified in the below Examples.

Additional Applications Using Unique Labeling Approaches

The invention further contemplates use of the dynamic labeling techniques described herein for a variety of other applications including but not limited to microbiological/pathogen diagnostic applications and cellular tracking, including in vivo cellular tracking, applications. Various applications that are amenable to the unique labeling methods of the invention are described in published PCT application WO2011/106536, published on Sep. 1, 2011, the entire contents of which are incorporated by reference herein.

Diagnostic/Pathogen Signature Applications

Thus, in one aspect, the methods and compositions provided herein may be used to generate molecular signatures for pathogens such as but not limited to bacteria, fungi and viruses, and may impart information about whether the bacteria have been exposed to one or more agents and if so the identity of such agent(s). In some embodiments, the agents may be anti-bacterials such as antibiotics, anti-viral, or anti-fungals.

Certain methods directed to pathogen identification may involve obtaining a sample known or suspected of containing a pathogen, concentrating and lysing any pathogens from the sample, and harvesting and detecting nucleic acids from the sample, wherein the nucleic acids are indicative of, or surrogate markers of, the pathogen(s) present in the sample. In some embodiments, the method further may comprise a step of enriching pathogens in the sample prior to concentration and lysis. The labeling methods of the invention are used to label and detect the nucleic acids from the sample, as described in greater detail below.

Certain methods directed to pathogen identification and drug susceptibility may involve obtaining a sample known or suspected of containing a pathogen, concentrating pathogens from the sample, partitioning the sample into subsets (or subpools) and exposing the subsets to different agents (e.g., antibiotics), lysing any pathogens following exposure to agent, and harvesting and detecting nucleic acids from the sample, wherein the nucleic acids are indicative of, or surrogate markers of, the pathogen(s) present in the sample. In some embodiments, the method further may comprise a step of enriching pathogens in the sample prior to concentration and lysis. In some embodiments, the sample may be cultured prior to concentration and the optionally enrichment step. The labeling methods of the invention are used to label and detect the nucleic acids from the sample, as described in greater detail below.

The foregoing methods may be carried out in microfluidic devices.

These diagnostic methods may be carried out on any number of samples including samples taken from a host (e.g., a human or an animal). These latter samples may be blood samples, urine samples, cerebrospinal fluid samples, etc.

Figure 31:
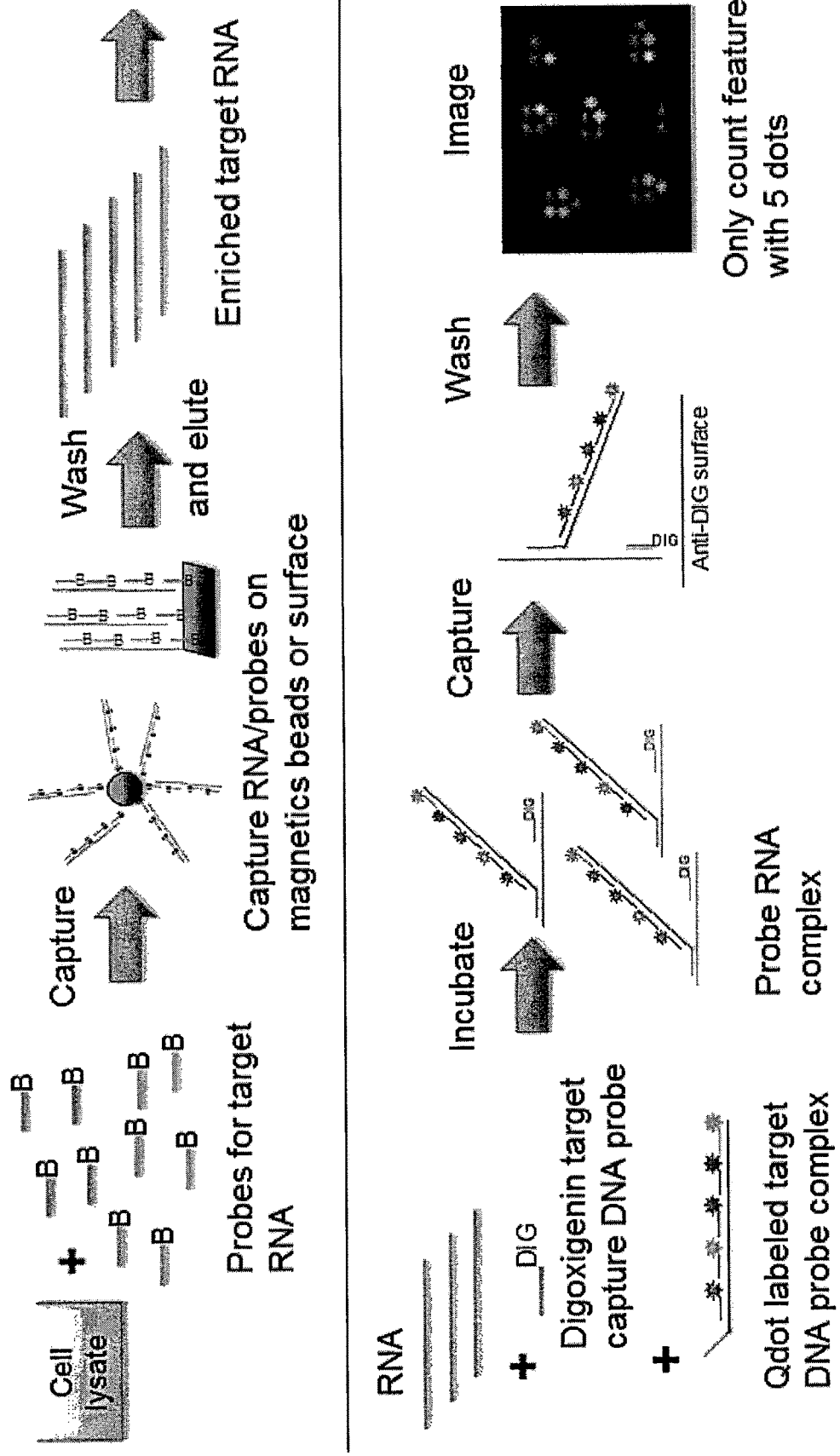
FIGS. 31-33 schematically illustrate a quantum dot RNA detection assay that can be used, inter alia, to detect and monitor pathogens.

FIG. 31 schematically illustrates a harvesting and labeling procedure that may be applied to detect the pathogen-specific nucleic acids such as those obtained through the foregoing methods. As illustrated in the Figure, a cell lysate which may comprise nucleic acid and non-nucleic acid components of a sample may be combined with a plurality of pathogen-specific nucleic acid probes. The probes may be biotinylated (shown in the Figure as "B"). The probes hybridize to their target pathogen RNA, and RNA hybridized to such probes is then physically separated from the remainder of the reaction mixture. In the Figure, the probes are biotinylated and the accordingly the probe/RNA hybrids are extracted using streptavidin (or avidin) coated beads. One of ordinary skill in the art will understand that the method may be performed using binding pairs other than biotin-avidin and using solid supports other than beads. In some instances, the RNA is mRNA.

Once the RNA is extracted, it may be initially labeled with a universal probe (i.e., a probe that hybridizes to all the RNA species). The universal probe will typically be detectably labeled (e.g., with a quantum dot or other fluorescent label or with an oligonucleotide label of the invention). This initial universal probe may indicate whether the sample was exposed to an agent, and optionally the agent type or identity. The use of this type of universal probe is not illustrated in the Figure. The Figure however does illustrate the use of another universal probe that is conjugated to digoxigenin (DIG) and that is used as a capture probe for all the harvested RNA. It is to be understood that the DIG label is exemplary and that other capture moieties may be used in its place including the oligonucleotide labels of the invention. RNA is bound to DIG-labeled universal probes and to RNA-specific, non-universal, probes that are differentially labeled. As an example, the Figure shows probes that are labeled with a set of five quantum dots ("Qdots") but it is to be understood that they may be labeled in any manner that results in a sufficient number of unique labels, including the nucleic acid-based labels of the invention. After hybridization, pathogen RNA molecules will be bound to the capture probe (e.g., the DIG-probe) and RNA-specific (e.g., Qdot-probe). The pathogen RNAs labeled in this manner are then captured on a solid support. The RNAs are captured to the solid support via interaction of DIG and anti-DIG antibody on the solid support. It will be understood that binding pairs other than DIG and anti-DIG antibody can be used. The RNAs are then imaged. If the detected moiety is a Qdot or other fluorescent moiety, then the image detects emissions from such moieties individually (as illustrated) or in some instances in combination. The image illustrates that each RNA is detected by a region of five distinct signals. Regions having less than five signals are disregarded. The combination of particular signals within each region indicate the identity of the RNA and thus act as the signature for the RNA. Assuming that 10 different detectable moieties are used (e.g., 10 Qdots) and 5 detectable moieties are used per probe, then 252 combinations are available for labeling (i.e., there are 252 unique labels available and therefore 252 different RNA species that may be distinguished from each other). If the method further included the use of another universal probe, the region of interest might contain yet another signal corresponding to the second universal probe.

Figure 32:
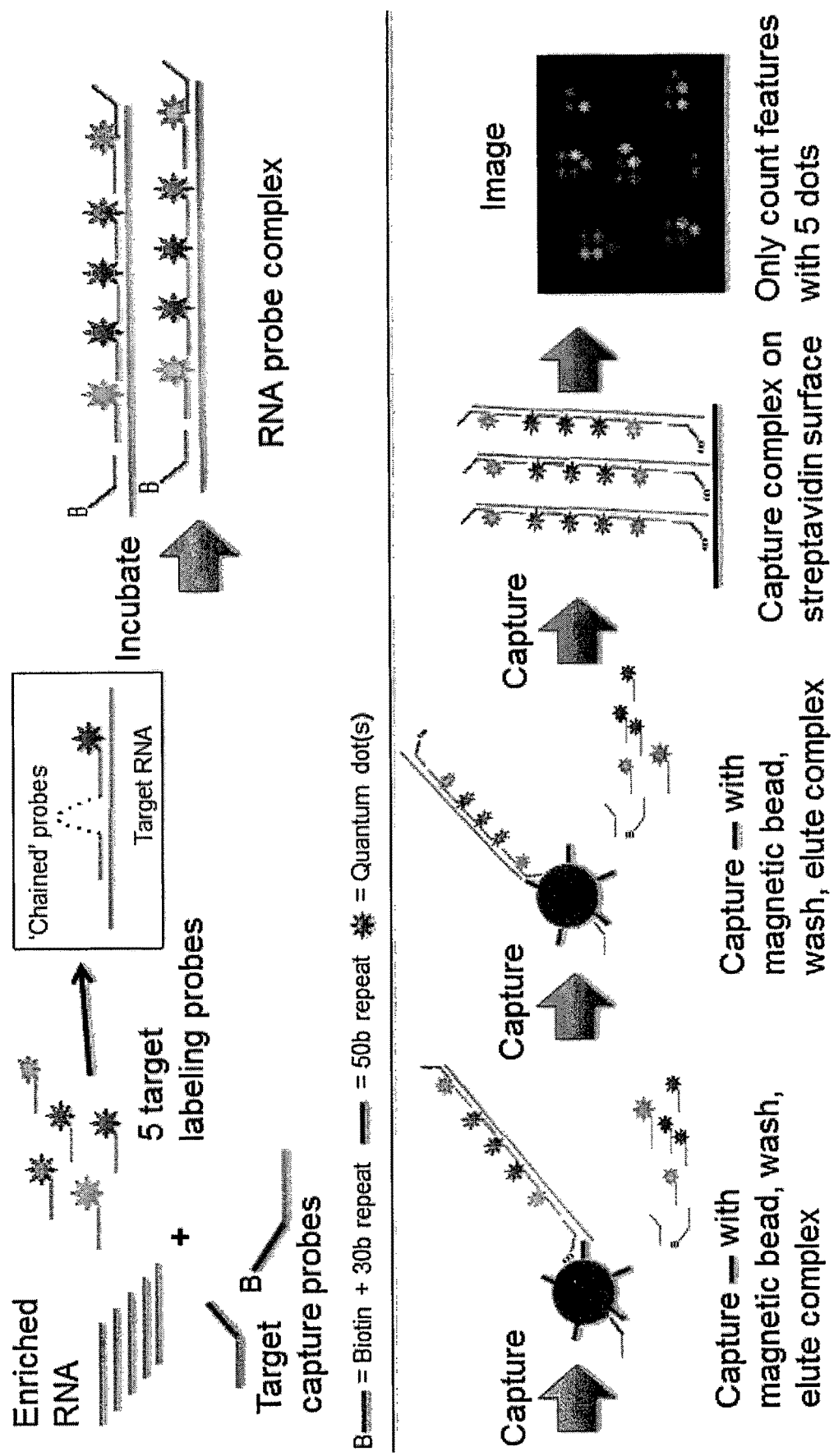
Figure 33:
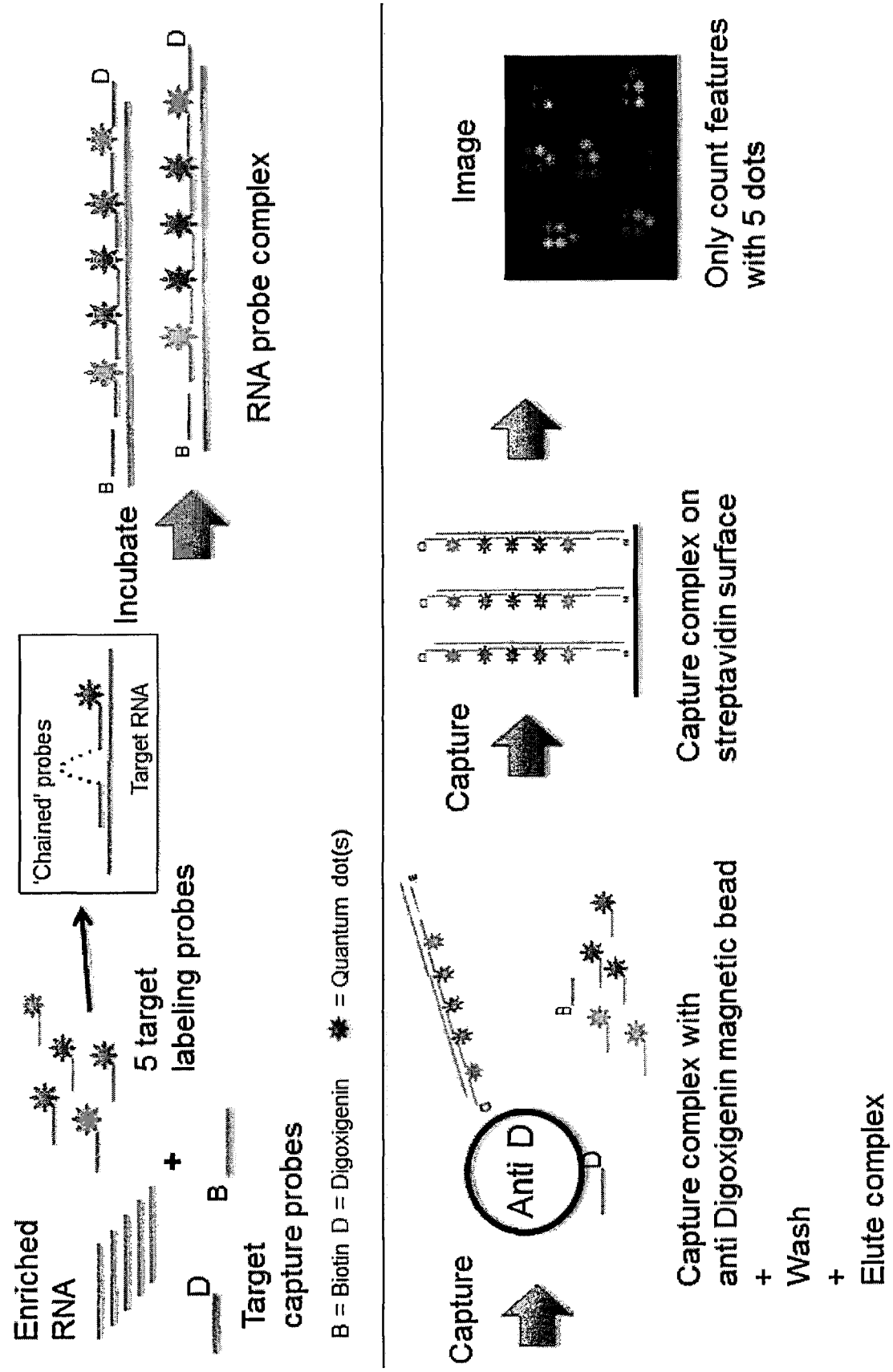
Figure 34:
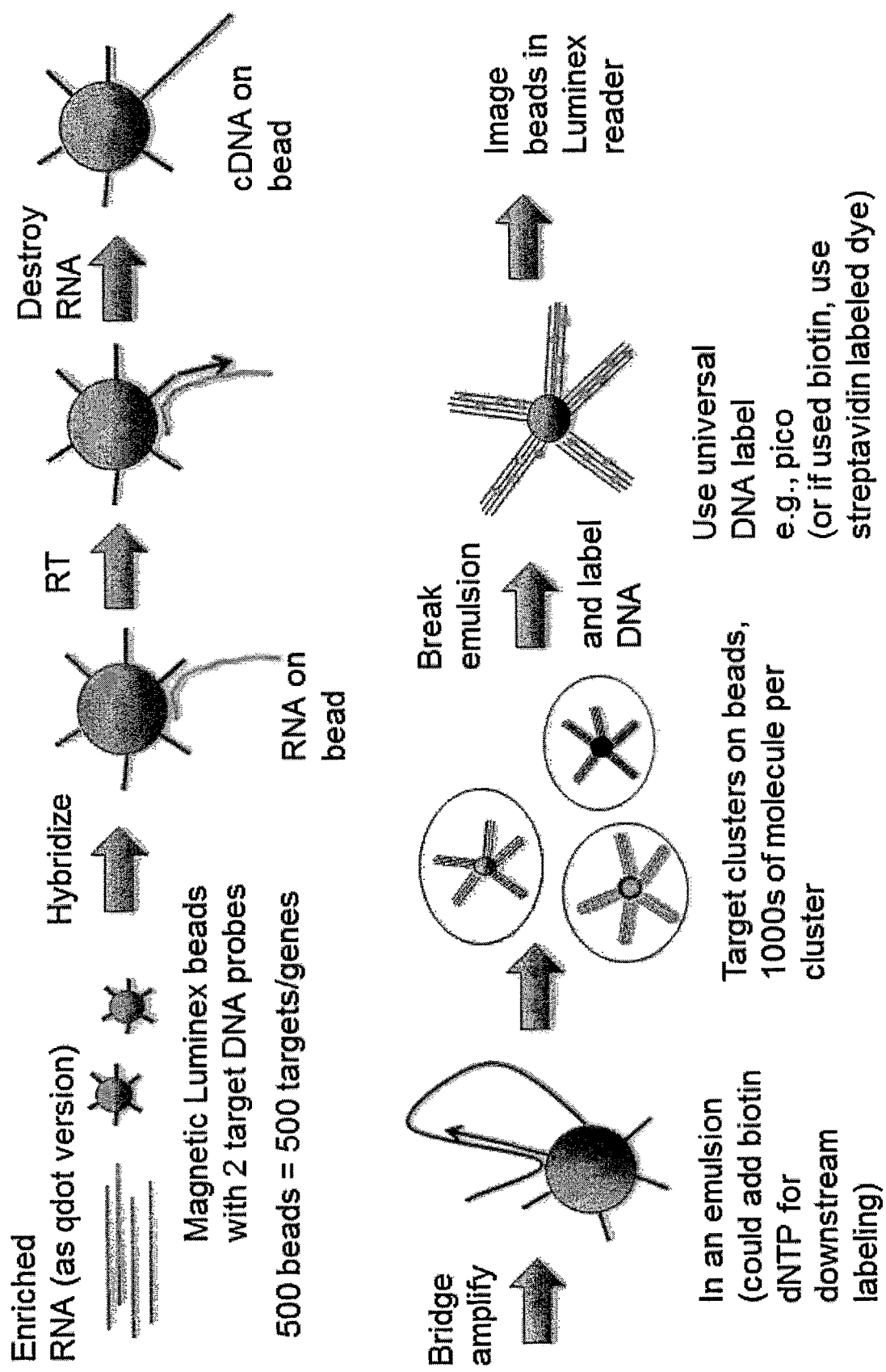
FIG. 34 is a schematic illustrating a luminex bead based RNA detection assay that can be used, inter alia, to detect and monitor pathogens.

Other labeling methods are provided in FIGS. 32-34. In FIG. 32, the enriched RNA is labeled with universal capture probes (that in this Figure are either 30 base sequences that are biotinylated, as denoted by "B", or are 50 base sequences) and with RNA-specific "labeling" probes (that in this Figure are each conjugated with a single quantum dot, but which may otherwise be labeled using the nucleic acid based labels of the invention). The configuration of the probes bound to the target RNAs is shown in the Figure, with the capture probes at the ends and the labeling probes at the internal region, thereby generating an RNA-probe complex. These complexes are then physically separated from other components of the labeling reaction mixture using streptavidin solid supports (such as beads or other surfaces) whereby the biotinylated RNAs are captured. This is followed by capture based on hybridization of the 50-mer sequence at the other end of the RNA using solid supports (such as beads or other surfaces) bound to complements of the 50-mer sequence. The RNAs are then detached from the second solid support and again captured on another streptavidin support and then imaged.

It is to be understood that the imaging methods illustrated in these Figures typically require that the RNAs are physically separated from each other and non-overlapping on a solid support. Accordingly, solid supports such as planar surfaces are suitable for such purposes.

A similar method is illustrated in FIG. 33. In this method, the capture probes are biotinylated probes and DIG-labeled probes. The initial capture step, to separate the RNA from other components in the labeling reaction mixture, uses the DIG labeled capture probe, and the final capture step, to separate RNAs from each other on a solid support (such as planar surface) uses the biotinylated capture probe.

Another method is illustrated in FIG. 34.

It is to be understood that any of the foregoing methods may be performed using a nucleic acid labeling approach as described herein rather than a fluorophore based labeling approach.

Accordingly, in some aspects, the invention provides methods of determining the sensitivity of a pathogen, e.g., a disease-causing organism such as a bacterium, fungus, virus, or parasite, to one or more agents. The agent may be a chemical agent such as a drug (e.g., antibiotic, anti-fungal, or anti-viral), or it may be a physical agent such as radiation. The methods include providing a sample known or suspected of having a pathogen and contacting the sample with one or more test agents, e.g., for less than four hours, to provide a test sample. The test sample then is treated under conditions that release RNA, such as mRNA, from the pathogen, and such RNA is exposed a plurality of nucleic acid probes. The probes may be represented by a plurality of subsets. The probes may be specific for RNA from pathogens known or suspected of being in the sample (i.e., pathogen-specific probes). Such probes may be used to determine if a particular pathogen is present and to quantitate the level of such pathogen. The probes may be pathogen-non-specific and thus able to bind to RNA from more than one pathogen. Such probes may be used to determine overall pathogen load in the sample. Such probes may also be used to identify and/or analyze pathogens that are resistant and pathogens that are susceptible to an agent. An example of such an assay is described below.

In one approach, the probes hind specifically to a target RNA, such as an mRNA, that is differentially expressed in pathogens that are sensitive to an agent as compared to pathogens that are resistant to the agent. Exposure of the target RNA and the probes occurs for a time and under conditions in which binding between the probe and target RNA can occur. The method may comprise determining a level of binding between the probe and target RNA, thereby determining a level of the target RNA, and comparing the level of the target RNA from a sample exposed to the in the presence of the test compound to a reference level, e.g., the level of the target mRNA in the absence of the test compound, wherein a difference in the level of target mRNA relative to the reference level of target mRNA indicates whether the pathogen is sensitive or resistant to the test compound.

The probes, including the pathogen-specific probes, may be labeled dynamically and/or statically, using for example the nucleic acid labeling techniques of the invention.

The pathogen may be known, e.g., an identified pathogen, or it may be an unknown pathogen, e.g., a yet to be identified pathogen. In the latter instance, the methods of the invention are used to detect a previously known pathogen.

The sample which may comprise the pathogen may be contacted with two or more agents, e.g., simultaneously or in the same sample, e.g., contacted with known or potential treatment agents, e.g., antibiotics, antifungals, antivirals, and antiparasitics. A number of these compounds are known in the art, e.g., isoniazid, rifampicin, pyrazinamide, ethambutol streptomycin, amikacin, kanamycin, capreomycin, viomycin, enviomycin, ciprofloxacin, levofloxacin, moxifloxacin, ethionamide, prothionamide, cycloserine, p-aminosalicylic acid, rifabutin, clarithromycin, linezolid, thioacetazone, thioridazine, arginine, vitamin D, R207910, ofloxacin, novobiocin, tetracycline, merepenem, gentamicin, neomycin, netilmicin, streptomycin, tobramycin, paromomycin, geldanamycin, herbimycin, loracarbef, ertapenem, doripenem, imipenem/cilastatin, meropenem, cefadroxil, cefazolin, cefalotin, cefalexin, cefaclor, cefamandole, cefoxitin, cefprozil, cefuroxime, cefixime, cefdinir, cefditoren, cefoperazone, cefotaxime, cefpodoxime, ceftazidime, ceftibuten, ceftizoxime, ceftriaxone, cefepime, ceftobiprole, teicoplanin, vancomycin, azithromycin, dirithromycin, erythromycin, roxithromycin, troleandomycin, telithromycin, spectinomycin, aztreonatn, amoxicillin, ampicillin, azlocillin, carbenicillin, cloxacillin, dicloxacillin, flucloxacillin, mezlocillin, methicillin, nafcillin, oxacillin, penicillin, piperacillin, ticarcillin, bacitracin, colistin, polymyxin B, enoxacin, gatifloxacin, lomefloxacin, norfloxacin, trovafloxacin, grepafloxacin, sparfloxacin, mafenide, prontosil, sulfacetamide, sulfamethizole, sulfanilimide, sulfasalazine, sulfisoxazole, trimethoprim, trimethoprim-sulfamethoxazole (co-trimoxazole), demeclocycline, doxycycline, minocycline, oxytetracycline, arsphenamine, chloramphenicol, clindamycin, lincomycin, ethambutol, fosfomycin, fusidic acid, furazolidone, metronidazole, mupirocin, nitrofurantoin, platensimycin, quinupristin/dalfopristin, rifampin, thiamphenicol, imidazole, cephalosporin, teicoplatin, augmentin, cephalexin, rifamycin, rifaximin, cephamandole, ketoconazole, latamoxef, or cefmenoxime.

Samples may be contacted with agents for a range of times including but not limited to 24 hours, 12 hours, 6 hours, 4 hours, less than four hours, e.g., less than three hours, less than two hours, less than one hour, less than 30 minutes, less than 20 minutes, less than 10 minutes, less than five minutes, less than two minutes, less than one minute.

These methods can be used to identify an infectious disease pathogen, e.g., a bacterium, fungus, virus, or parasite, e.g., *Mycobacterium tuberculosis*, e.g., detecting the presence of the pathogen in a sample, e.g., a clinical sample.

The methods include providing a test sample from a subject suspected of being infected with a pathogen, treating the test sample under conditions that release RNA such as mRNA, exposing the test sample to a plurality of nucleic acid probes, which may comprise a plurality of subsets of probes, wherein each subset may comprise one or more probes that bind specifically to a target RNA that uniquely identifies a pathogen, wherein the exposure occurs for a time and under conditions in which binding between the probe and the target mRNA can occur, and determining a level of binding between the probe and target RNA, thereby determining a level of target RNA. An increase in the target RNA of the test sample, relative to a reference sample, indicates the identity of the pathogen in the test sample. Each probe may be uniquely labeled using any of the labeling techniques of the invention, including the nucleic acid based labeling techniques.

It is to be understood that RNA may be labeled in a static manner, in a dynamic manner, or in a combination of static and dynamic manners. As used herein, static labeling refers to the generation of a unique label and affixing of the prepared unique label to a target of interest such as a single mRNA. As used herein, dynamic labeling refers to the unique labeling of a target by affixing to the target individual detectable moieties such as oligonucleotide tags or fluorescent moieties one at a time to generate a unique label. In a dynamic labeling approach, a label affixed to the target may represent information about the target. In these diagnostic methods, the label may represent whether the sample has been exposed to an agent and optionally the identity of the agent. Some labels may be used to distinguish RNA from each other. Other labels may be used to denote particular information about the RNA such as whether it came from a sample from a particular subject or from a sample treated in a particular manner. The invention contemplates that virtually any organism may be traced, identified and monitored using the methods of the invention.

The sample may be or may comprise sputum, blood, urine, stool, joint fluid, cerebrospinal fluid, and cervical/vaginal swab. Such samples may include a plurality of other organisms (e.g., one or more non-disease causing bacteria, fungi, viruses, or parasites) and/or pathogens. In some embodiments, the sample is a clinical sample, e.g., a sample from a patient or person who is or may be undergoing a medical treatment by a health care provider.

The RNA may be crude, e.g., not purified, before contact with the probes and/or may not be amplified. The cells may be lysed enzymatically, chemically, and/or mechanically. The methods may comprise use of a microfluidic device.

The methods may be used to monitor pathogen infection, e.g., incidence, prevalence, for public health surveillance of an outbreak of a pathogen, e.g., a sudden rise in numbers of a pathogen within a particular area.

The sample may be obtained from a subject such as but not limited to humans and animals, such as laboratory animals, e.g., mice, rats, rabbits, or monkeys, or domesticated and farm animals, e.g., cats, dogs, goats, sheep, pigs, cows, horses, and birds, e.g., chickens.

The methods may further comprise determining and/or selecting a treatment for the subject and optionally administering the treatment to the subject, based on the outcome of an diagnostic assay as described herein.

In another general aspect, the invention features methods of selecting a treatment for a subject. The methods include optionally identifying an infectious disease pathogen (e.g., detecting the presence and/or identity of a specific pathogen in a sample), e.g., using a method described herein, determining the drug sensitivity of the pathogen using the methods described herein, and selecting a drug to which the pathogen is sensitive for use in treating the subject.

In yet another aspect, the invention provides methods for monitoring an infection with a pathogen in a subject. The methods include obtaining a first sample which may comprise the pathogen at a first time, determining the drug sensitivity of the pathogen in the first sample using the method described herein, optionally selecting a treatment to which the pathogen is sensitive and administering the selected treatment to the subject, obtaining a second sample which may comprise the pathogen at a second time, determining the drug sensitivity of the pathogen in the second sample using the method described herein, and comparing the drug sensitivity of the pathogen in the first sample and the second sample, thereby monitoring the infection in the subject. In some embodiments of the methods described herein, the subject is immune compromised.

In some embodiments of the methods described herein, the methods include selecting a treatment to which the pathogen is sensitive and administering the selected treatment to the subject, and a change in the drug sensitivity of the pathogen indicates that the pathogen is or is becoming resistant to the treatment, e.g., the methods include determining the drug sensitivity of the pathogen to the treatment being administered. in some embodiments, a change in the drug sensitivity of the pathogen indicates that the pathogen is or is becoming resistant to the treatment, and the method further may comprise administering a different treatment to the subject.

In yet another aspect, the invention features methods of monitoring an infection with a pathogen in a population of subjects. The methods include obtaining a first plurality of samples from subjects in the population at a first time, determining the drug sensitivity of pathogens in the first plurality of samples using the method described herein, and optionally identifying an infectious disease pathogen in the first plurality of samples using the method described herein, optionally administering a treatment to the subjects, obtaining a second plurality of samples from subjects in the population at a second time, determining the drug sensitivity of pathogens in the second plurality of samples using the method described herein, and optionally identifying an infectious disease pathogen in the first plurality of samples using the method described herein, comparing the drug sensitivity of the pathogens, and optionally the identity of the pathogens, in the first plurality of samples and the second plurality of samples, thereby monitoring the infection in the population of subject.

"Infectious diseases" also known as communicable diseases or transmissible diseases, comprise clinically evident illness (i.e., characteristic medical signs and/or symptoms of disease) resulting from the infection, presence, and growth of pathogenic biological agents in a subject (Ryan and Ray (eds.) (2004). Sherris Medical Microbiology (4th ed.). McGraw Hill). A diagnosis of an infectious disease can confirmed by a physician through, e.g., diagnostic tests (e.g., blood tests), chart review, and a review of clinical history. In certain cases, infectious diseases may be asymptomatic for some or all of their course. Infectious pathogens can include viruses, bacteria, fungi, protozoa, multicellular parasites, and prions. One of skill in the art would recognize that transmission of a pathogen can occur through different routes, including without exception physical contact, contaminated food, body fluids, objects, airborne inhalation, and through vector organisms. Infectious diseases that are especially infective are sometimes referred to as contagious and can be transmitted by contact with an ill person or their secretions.

As used herein, the term "gene" refers to a DNA sequence in a chromosome that codes for a product (either RNA or its translation product, a polypeptide). A gene contains a coding region and includes regions preceding and following the coding region (termed respectively "leader" and "trailer"). The coding region is comprised of a plurality of coding segments ("exons") and intervening sequences ("introns") between individual coding segments.

The term "probe" as used herein refers to an oligonucleotide that binds specifically to a target such as a nucleic acid such as mRNA. A probe can be single stranded at the time of hybridization to a target.

16S Amplicon Tagging

In another embodiment, the labeling methods described herein can be used to characterize pathogen populations by labeling nucleic acid regions of interest. For example, the 16S region in a bacterium can be used to identify and distinguish species of bacteria present in a sample. The 16S region is the target of numerous studies that seek to characterize the microbial community present in a given sample (e.g., human microbiome studies). The prokaryotic 16S ribosomal RNA is composed of 4 different subunits spanning approximately 1,500 base pairs in length. Current sequencing technologies make it difficult and in some cases impossible to accurately characterize the 16S region due to either prohibitively high error rates or long read lengths. To overcome these problems, the 16S region may he analyzed by PCR using primers designed to amplify each of the 4 subunits separately. The method described herein is unique in that it allows for tagging amplicons from a large population of individual cells such that an explicit and identifiable association can be made among all 4 amplicons on a cell-by-cell basis. Once tagged, all downstream sample processing can be performed in bulk, which allows for both workflow streamlining and cost reduction. Importantly, additional tagging information can be added to these samples downstream allowing for the capture of additional layers of sample history information.

Figure 35:
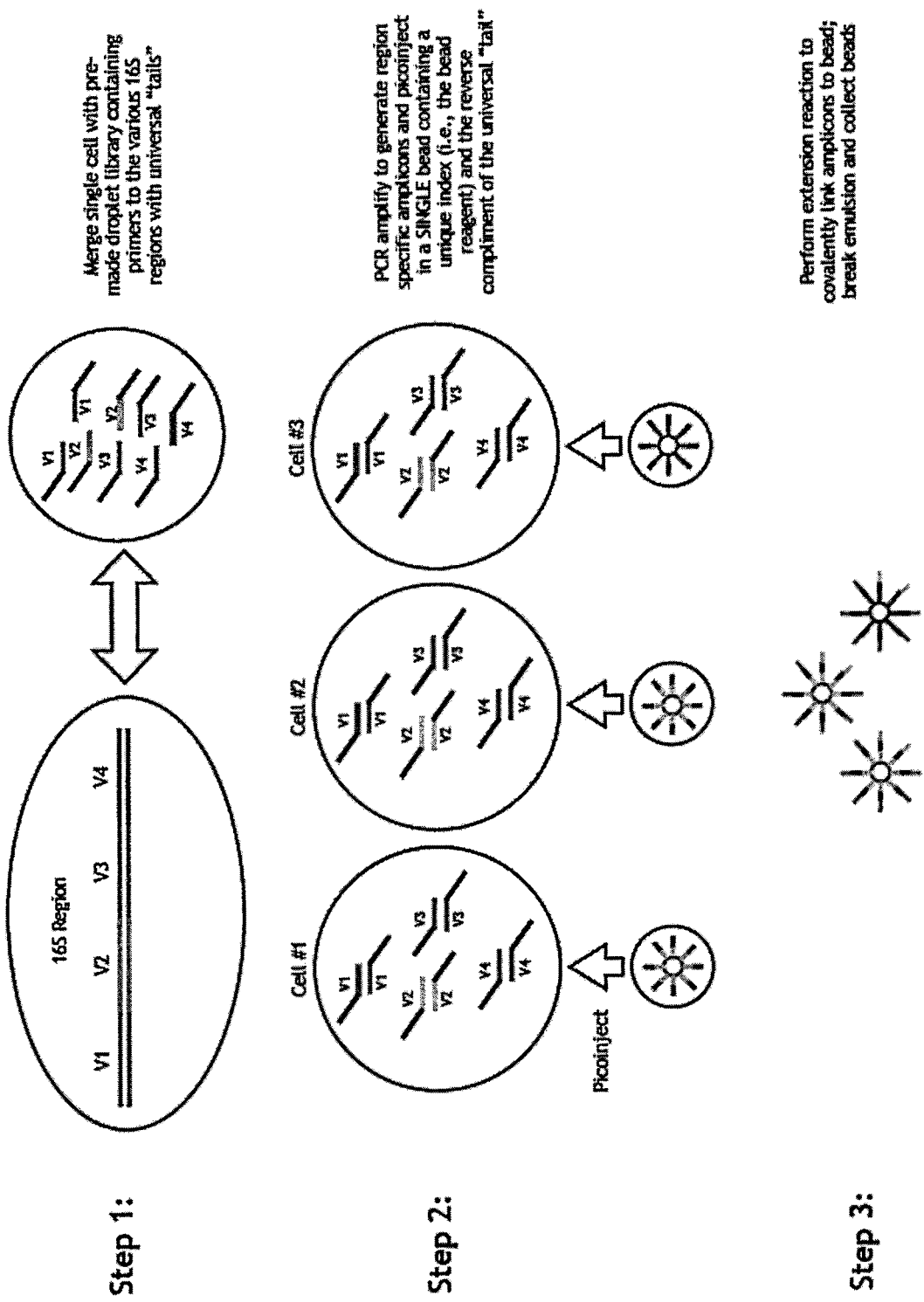
FIG. 35 is a schematic illustrating 16S amplicon tagging that can be used, inter alia, to distinguish different species of bacteria.

FIG. 35 is a schematic showing an exemplary technique for amplifying and tracking 16S regions using the methods and labels described herein. For this technique, cells are distributed into an emulsion such that each droplet only contains a single cell. The single cell emulsion is then merged to a previously constructed droplet library containing PCR primers designed to amplify each of the four 16S regions. Although each primer is designed to amplify a specific region, every primer carries a common (universal) tailing sequence. Cells may be lysed either prior to droplet merging or during PCR amplification of the 16S amplicons. Following PCR, a single bead carrying a unique index sequence (e.g., a detectable oligonucleotide tag created using the methods described herein) is added to each droplet through droplet merging, picoinjection, etc. Although each bead carries a unique index sequence, it also carries a common sequence complimentary to the universal tail present on the PCR primers. Following annealing of the amplicons to the beads via the universal tail sequence, the amplicons become covalently linked to the bead via a polymerization (extension) reaction. Once attached to the beads, the emulsion can be broken and all downstream processing can be performed in bulk.

Any desirable solid support can be used in place of beads, e.g., polymers, glass, nanoparticles, hydrogels or peptides. Alternatively, labeling can be performed in the absence of a solid support (e.g., in an emulsion). Agents other than 16S ribosome amplicons can be labeled, e.g., a nucleic acid such as a portion of a genome, a gene, a promoter, a coding sequence of a gene, a cDNA, or an RNA. Use of emulsion droplets can be replaced with separation of agents, e.g., using microwells or tubes. This technique is useful generally for assessing any sample (e.g., a cell, a genome, a transcriptome, a sample containing multiple organisms or cells) where prohibitively high error rates and/or long read lengths are an issue.

RNA Extraction and Analysis

RNA can be extracted from cells in a sample, e.g., a pathogen cell or clinical sample, by treating the sample enzymatically, chemically, or mechanically to lyse cells the sample and release mRNA. It will be understood by skilled practitioners that other disruption methods may be used in the process.

The use of enzymatic methods to remove cell walls is well-established in the art. The enzymes are generally commercially available and, in most cases, were originally isolated from biological sources. Enzymes commonly used include lysozyme, lysostaphin, zymolase, mutanolysin, glycanases, proteases, and mannose.

Chemicals, e.g., detergents, disrupt the lipid barrier surrounding cells by disrupting lipid-lipid, lipid-protein and protein-protein interactions. The ideal detergent for cell lysis depends on cell type and source. Bacteria and yeast have differing requirements for optimal lysis due to the nature of their cell wall. In general, nonionic and zwitterionic detergents are milder, The Triton X series of nonionic detergents and 3-[(3-Chollami dopropyl)dimethylammonio]-1-propanesulfonate (CHAPS), a zwitterionic detergent, are commonly used for these purposes. In contrast, ionic detergents are strong solubilizing agents and tend to denature proteins, thereby destroying protein activity and function. SDS, an ionic detergent that binds to and denatures proteins, is used extensively in the art to disrupt cells.

Physical disruption of cells may entail sonication, French press, electroporation, or a microfluidic device which may comprise fabricated structures can be used to mechanically disrupt a cell. These methods are known in the art.

RNA extraction can be coupled with the labeling methods described herein in order to characterize transcripts present in a single cell or population of cells. Currently available platforms/techniques such as the Fluidigm C1 instrument enable the study of the transcriptomes at the single cell level. The throughput of such instruments, however, is comparatively low. The C1 instrument, for example, allows for the parallel processing of up to 96 cells. The methods described herein allows for scalable, massively parallel processing of single cells in numbers that are orders of magnitude beyond any currently available platforms.

Labeling for Quantitative Analysis of Agents

Also contemplated herein is a method of labeling agents such that quantitative information about the agents can be extracted. Quantitative information includes the number or level of an agent present in a sample or cell. Examples include transcript expression levels in a cell or a sample, chromosome copy numbers in a cell or a sample, and number of PCR amplicons in a sample, This method can be used, inter alia, to quantify relative number or level of a transcript in a cell or tissue, or relative number or level of a cell such as bacteria in a sample.

In an exemplary method, a solid support, such as a bead or polymer, carries a plurality of nucleic acid labels. The nucleic acid labels on a bead contain common sequences (i.e., sequences present on all the labels on a single solid support) and unique sequences (i.e., sequences that distinguish each label from other labels on the solid support). The common sequences include a capture sequence such as a poly(dT) sequence. Common capture sequences may be common throughout all solid supports used in a particular analysis (e.g., if all solid supports are used to capture transcripts, then all labels may comprise a common poly(dT) sequence. The common sequences also include a first detectable oligonucleotide sequence or tag (which may be comprised of one or more index sequences). This first detectable oligonucleotide sequence or tag is unique to the solid support (i.e., it distinguishes the solid support from other solid supports, and thus distinguishes the plurality of transcripts bound to the solid support from other pluralities of transcripts bound to other solid supports). In this way, transcripts from a single cell may be identified as such. The nucleic acid label may also contain a unique sequence. This unique sequence is referred to as the second detectable oligonucleotide sequence or tag and it may be comprised of one or more index sequences). This sequence differs between labels on a single solid support so that each label may comprise a unique sequence. The first and second detectable oligonucleotide sequences may be generated using the methods described herein.

The detectable oligonucleotide sequences may be generated apart from the solid support and then attached to it. Alternatively, the sequences may be generated while attached to the support. As an example, the first detectable oligonucleotide sequence may be first generated and then attached to the solid support, following which the second detectable oligonucleotide sequence is generated directly on the support. In some embodiments, the second sequence is attached to the first sequence by combining an excess of the second sequences to the first sequences (which may or may not be attached to the solid support). Attachment may occur e.g., by ligation or polymerase-mediated attachment. The ensures that the solid support is exposed to a very large number of second sequences, much larger than the number of first sequences present on the solid support, such that each nucleic acid label on the solid support contains a unique second sequence. The labeling of the solid support could thus be performed as a bulk reaction with a large number of the previously first-sequence-labeled solid supports present in the same reaction. Alternatively, the first and second sequences are generated to form the nucleic acid label and then attached to the solid support.

As another alternative, nucleic acid labels appropriate for quantitative analysis are generated and used in the absence of a solid support (e.g., in an emulsion). The nucleic acid labels, either present on a solid support or alone, are then associated with one or more agents. A population of agents (e.g., RNA transcripts from a single cell) are uniquely labeled compared to other populations of agents using the first sequence (i.e., the common but not capture sequence) of the nucleic acid label. Subgroups of agents or individual agents (e.g., a single RNA transcript in a pool of RNA transcripts from a single cell) are uniquely labeled compared to other subgroups of agents or other individual agents in the same population using the second nucleic acid (i.e., the unique sequence) of the nucleic acid label. Thus, the number of subgroups or individual agents present in a population can be quantified.

In the example of quantitative transcriptome analysis, a sample containing multiple cells is processed and put into an emulsion such that droplets are formed. Cells are lysed either immediately prior to droplet formation (e.g., hypotonic lysis) or once they have already been encapsulated in an emulsion (e.g., freeze-thaw cycling), releasing the mRNA from the cell into the droplet. A single bead containing nucleic acid labels generated as described above is then introduced into the droplet (e.g., by droplet merging or picoinjection). Each nucleic acid label contains, in addition to the first (common) and second (unique) sequences, an oligo(dT) capture sequence that binds to the polyA tail present on each mRNA transcript. Each nucleic acid label captures one mRNA and is processed through a first strand cDNA synthesis reaction to create a copy of the RNA sequence that is covalently linked to the labeled solid support. Each copy of the mRNA sequence will then contain the first sequence of the nucleic acid label, which is common to every mRNA on the same solid support, and the second sequence of the nucleic acid label, which is unique to every individual mRNA in the same solid support. This allows for the number of original mRNA molecules to be quantified, as each original individual mRNA will have a unique sequence that is carried through further processing and/or amplification.

Cell Tracking Applications

In still other aspects, the invention provides methods of tracking cells by uniquely labeling such cells using methods of the invention and/or variations thereof. For example, the invention contemplates that cells may be uniquely labeled using viruses that stably integrate into the genome at random positions. Such cells may be administered to a subject and the effect of such cells monitored. Such cells may be further labeled using the same or different viruses that stably integrate into the genome. It is to be understood that in some instances the unique labeling of the cells using such viruses results not from the virus itself, since the same viral sequence will integrate into a plurality of cells, but rather from the particular location of integration of the virus. If the virus is engineered to carry and integrate a primer sequence (along with the viral sequence), then it and its neighboring sequence at the site of integration can be amplified and sequenced, and thereby distinguished from other integration events.

The invention contemplates that a cell may be infected with a virus, including a different virus, per condition to which it is exposed. For example, a population of cells may be initially infected with virus A and then subsequently infected with virus B upon exposure to condition B. Viruses A and B are able to stably integrate into the genome of the host subject and their particular integration patterns will differ from and likely be unique compared to the integration patterns in another cell. In this way, cells may be uniquely labeled, including labeled in a dynamic manner to reveal information about the cell such as prior history of the cell.

Reference can be made to Lu et al. Nature Biotechnology, 2011, 29(10):928-934, the entire teachings of which are incorporated by reference herein.

Tagging Epigenetics Constructs

In a further embodiment, the solid supports including beads have been labeled using the combinatorial split-pool synthesis methods to generate a population of identically labeled oligos attached to the solid support. These oligos may be cleavable such that they can be released into, for example, a multi-well plate or a droplet and ligated onto the free ends of DNA bound by chromatin or any other nucleic acids in the cell. These released oligos contain the barcode generated by split pool synthesis and a T7 promoter such that only the nucleic acids ligated by the oligos are amplified in an in vitro transcription reaction following emulsion breaking. This allows for the single cell labeling of Chromatin states as described in PCT/US2013/029123 and published as WO 2013/134261, the entire contents of which are incorporated by reference herein.

Labeling Nucleic Acid-Protein Complexes

The methods described above can also be used to label various nucleic acid-protein complexes. Methods such as chromatin immunoprecipitation (e.g., ChIP and ChIA-PET), chromosome conformation capture (e.g., 3C and Hi-C) and various RNA-protein pull-down methods are designed to associate (crosslink) nucleic acids to various proteins.

The three-dimensional (3D) conformation of chromosomes is involved in compartmentalizing the nucleus and bringing widely separated functional elements into close spatial proximity. Understanding how chromosomes fold can provide insight into the complex relationships between chromatin structure, gene activity, and the functional state of the cell. Long-range interactions between specific pairs of loci can be evaluated with chromosome conformation capture (3C), using spatially constrained ligation followed by locus-specific polymerase chain reaction (PCR). Adaptations of 3C have extended the process with the use of inverse PCR (4C) or multiplexed ligation-mediated amplification (5C). Still, these techniques require choosing a set of target loci and do not allow unbiased genome wide analysis. The method. Hi-C adapts the above approach to enable purification of ligation products followed by massively parallel sequencing. Hi-C allows unbiased identification of chromatin interactions across an entire genome. Aspects of the method include cells being crosslinked with formaldehyde; DNA being digested with a restriction enzyme that leaves a 5' overhang; the 5' overhang is filled, including a biotinylated residue; and the resulting blunt-end fragments are ligated under dilute conditions that favor ligation events between the cross-linked DNA fragments. The resulting DNA sample contains ligation products having fragments that were originally in close spatial proximity in the nucleus, marked with biotin at the junction. A Hi-C library may then be created by shearing the DNA and selecting the biotin-containing fragments with streptavidin beads. The library is then analyzed by using massively parallel DNA sequencing, producing a catalog of interacting fragments. This is further described in Lieberman-Aiden E et al., Comprehensive mapping of long-range interactions reveals folding principles of the human genome, *Science*. 2009 Oct 9;326 (5950):289-93, the contents of which are incorporated herein in their entirety. Thus, instead of using processes such as circularization to covalently link nucleic acids together within a given complex, the labeling methods described above can he leveraged in order to uniquely label the components of each complex.

EXAMPLES

The following Examples are meant for illustrative purposes, and are not meant to be exclusive or limiting. Each Example illustrates a method for labeling a specific type of construct (e.g., genomic DNA or a solid support), but it is to be understood that these methods also apply to any type of constructs that can be attached to an oligonucleotide by some means. For example, covalent attachment of a nucleotide adapter to a non-nucleotide-based construct, e.g. a protein, a cell, or a chemical, would allow for addition of unique oligonucleotide labels to a non-nucleotide-based constructs.

Example 1

Figures 1, 3A:
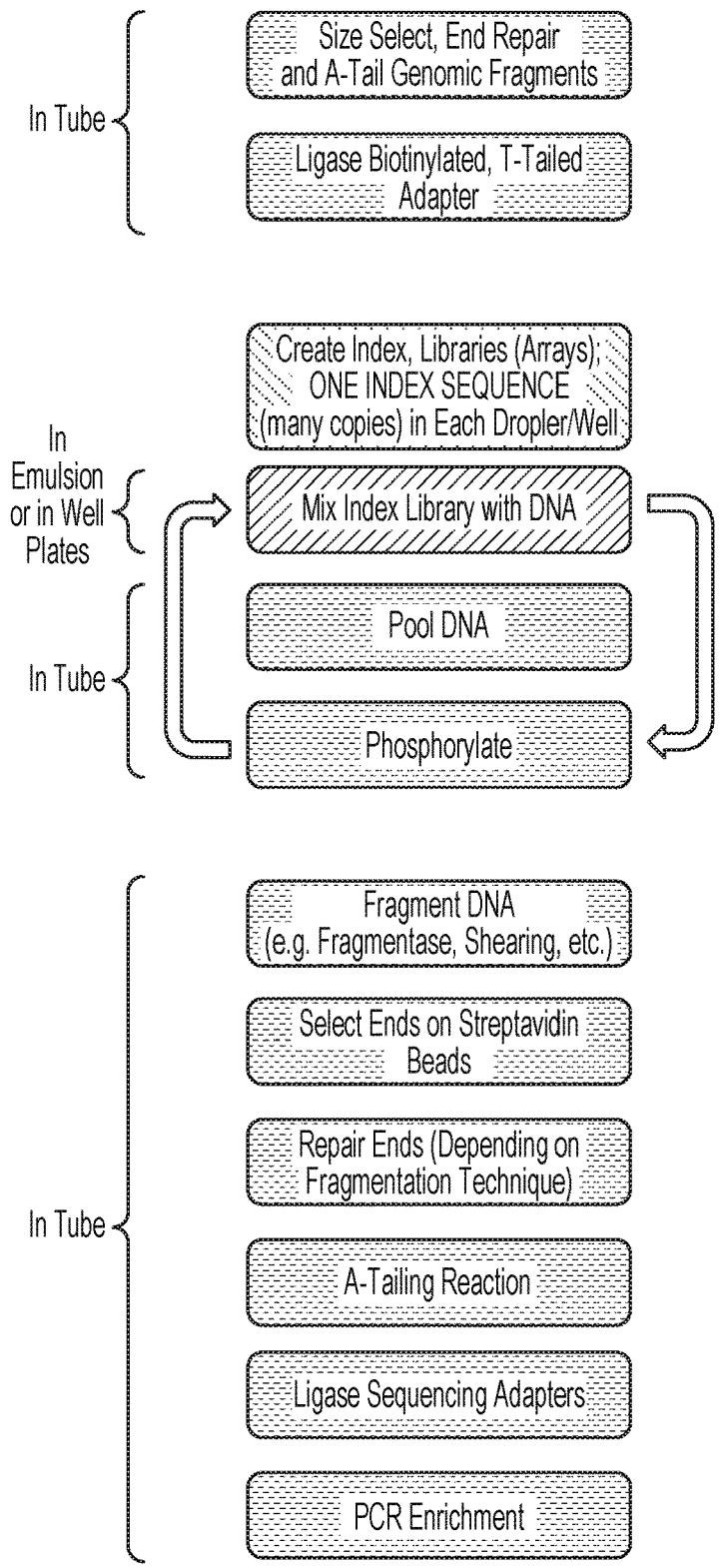
Figure 3B:
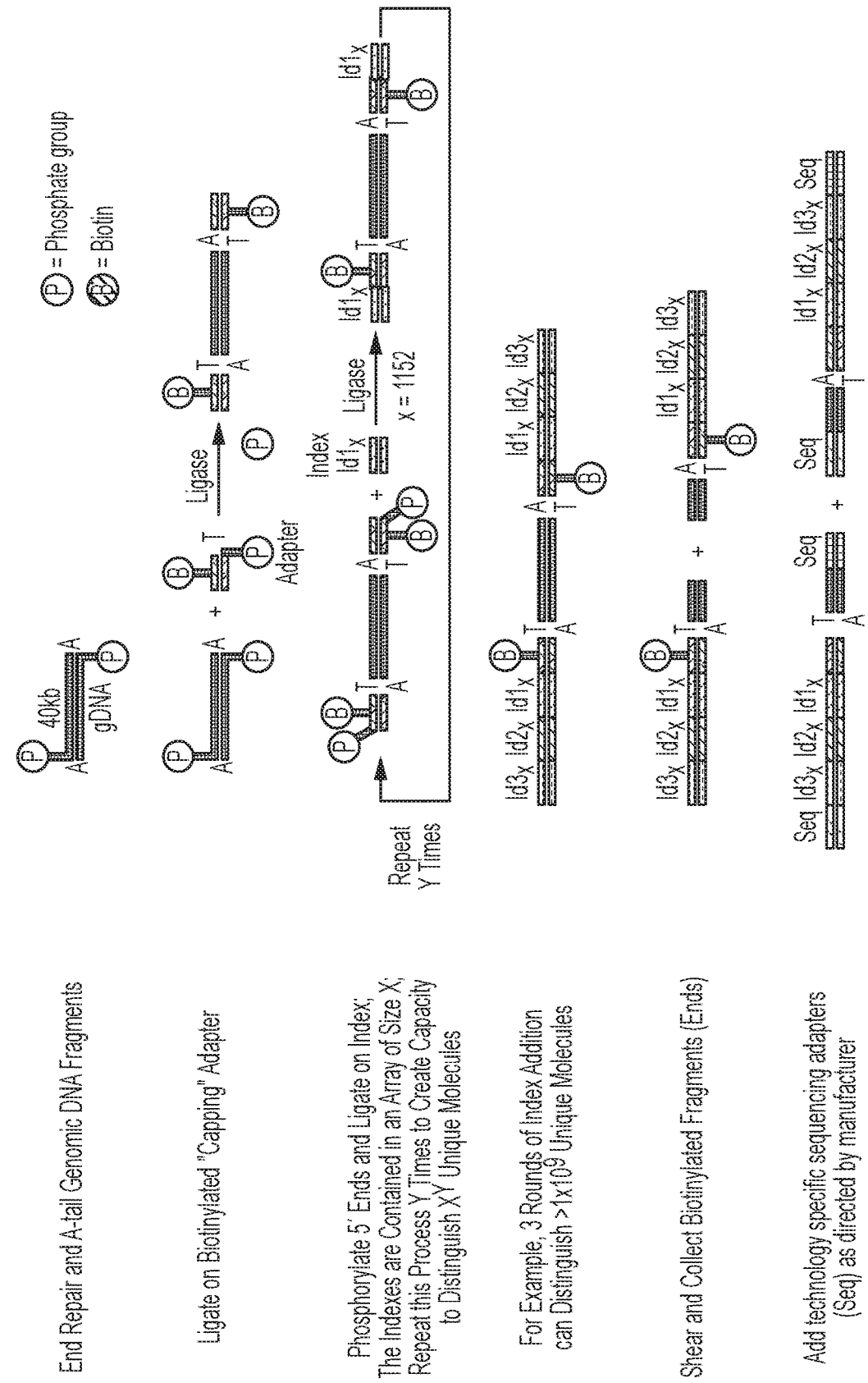
FIG. 3B is a schematic illustrating a recursive indexing strategy of the invention.
Figure 3C:
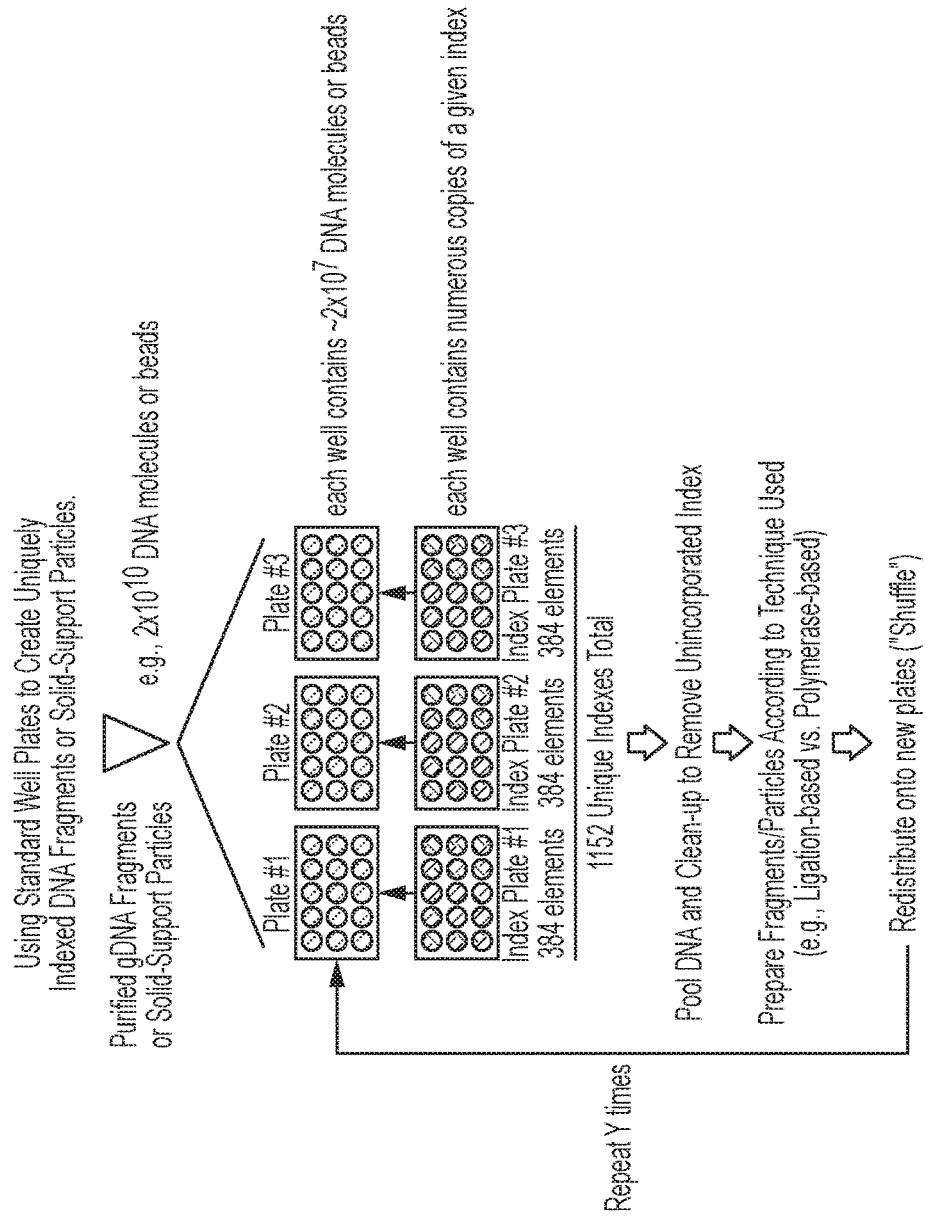
FIG. 3C is a schematic illustrating index addition to either beads or DNA using multi-well plates.
Figures 1, 3D:
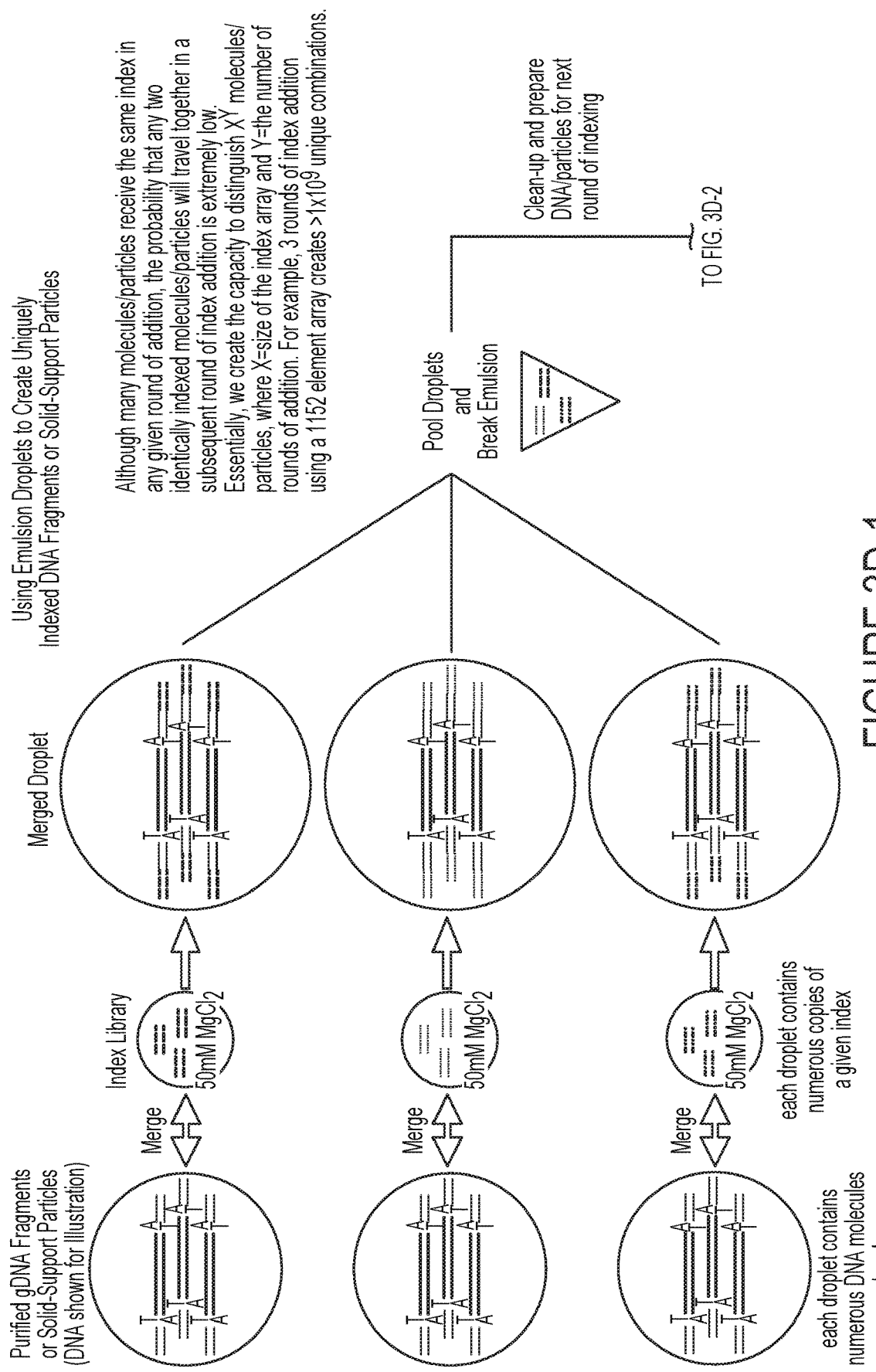

Polymerase-Mediated Bioinformatic Association of Nucleic Acid Ends for Mate-Pair Analysis Generation of End-Labeled Genomic DNA Fragments A method for bioinformatically associating the ends of genomic DNA is outlined in FIG. 1. Genomic DNA is fragmented and size selected to a known size using techniques known in the art (e.g., sonication, cavitation, point-sink or mechanical shearing, or a DNA fragmenting enzyme and size-exclusion columns or gel purification). The genomic DNA is then A-tailed and ligated to a biotinylated, T-tailed asymmetric oligonucleotide adapter using methods known in the art (see, e.g. Maniatis, Molecular Cloning). Klenow exo-enzyme is commonly used to add a single nucleotide to the 3' termini of DNA fragments). The adapter is a partial duplex to allow for annealing of the single-stranded oligonucleotide indexes described below.

One or more index libraries (preferably 1-4 libraries) are created such that each library contains approximately >1000 unique single-stranded oligonucleotide indexes, thus approximately 2000-4000 unique indexes are used. Index libraries may be created in droplets using standard flow focusing techniques (ref) or placed in the wells of standard laboratory plasticware (e.g., 384-well or 1152-well plates). For a given library, each droplet/well will contain many copies of one unique single-stranded index. Droplets/wells may contain some or all of the key components of a polymerase fill-in reaction (e.g., $MgCl_2$, dNTP, and Polymerase). Each unique single-stranded oligonucleotide index contains 3 distinct regions: sequence complimentary to the adapter (Ad) or to a previously added index sequence (B or C), a unique index sequence (Idx), and a sequence used to "capture" the next index oligonucleotide index which contains one or more dUTP nucleotides (B'/C').

Fragmented genomic DNA ligated to an adapter is diluted to a desired concentration to control the number of molecules per droplet/well (e.g., a single DNA molecule per droplet/well or more than a single DNA molecule per droplet/well) and merged with (see above references for droplet merging)/added to the first index library (Library "A" in FIG. 1.).

The Ad region of each unique single-stranded oligonucleotide index binds to the adapter on each end of the fragmented genomic DNA molecule. A polymerase-mediated fill-in reaction is performed in each droplet, creating the complement to the index and capture regions on the each unique single-stranded oligonucleotide index a, and thus generating unique double-stranded oligonucleotide indexes.

If emulsion droplets are utilized, they are then broken using various mechanical or chemical reagents depending on the oil/surfactant utilized in the emulsion, resulting in the combination and mixing of the DNA from each droplet. If standard plastic labware is used, samples in all wells are pooled together, resulting in the combination and mixing of the DNA from each well. Mixed DNA is the treated with USER™ enzyme (Uracil-Specific Excision Reagent, New England. BioLabs Inc., Ipswich, Mass.), causing the capture portion of the double-stranded oligonucleotide index to be digested due to the presence of one or more dUTP nucleotides. This digestion reveals the nascent strand, which is complementary to a sequence contained in the next library of indexes (Library "B" in FIG. 1).

The process of fragmented genomic DNA dilution, merging with a droplet library or mixing in standard labware, polymerase fill-in, breaking the droplets or pooling the wells, and treatment with USER™ enzyme is repeated for the desired number of cycles, each time adding one new unique oligonucleotide index sequence to both ends of the fragmented genomic DNA.

After the final index addition, the result is fragmented genomic DNA uniquely end-labeled on both the 5' and 3' end with a unique label made up of many oligonucleotide indexes. The uniquely end-labeled fragmented genomic is then fragmented and the ends are collected via streptavidin beads, which recognized the biotin label on the adapter. Fragments can be ligated to technology specific sequencing adapters (e.g., lumina adapters) and sequenced. Ends are informatically paired by matching the unique label on one fragment of DNA with the same unique label on the other fragment of DNA (see FIG. 3E).

This method of bioinformatics association can also be used with other types of nucleic acids, such as RNA, cDNA, or PCR-amplified DNA, or any other type of construct where such a labeling scheme is required. This method can also be performed in well plates instead of emulsion droplets. To accomplish this, arrays of oligonucleotide indexes are prepared in 384-well (or 1536-well) plates. 1 to 4 index arrays are created, each containing ~1000 unique indexes for a total of ~1000-4000 unique indexes. Fragmented genomic DNA is aliquoted into at least one index array 384-well (or 1536-well) plate at a desired density. After the index is attached to the fragmented genomic DNA, the index-labeled fragmented genomic DNA is optionally purified and then pooled together with the other index-labeled fragmented genomic DNA molecules. The index-labeled fragmented genomic DNA molecules are then redistributed to a second set of index arrays either containing the same set of unique indexes previously used or new unique indexes. The pooling of the index-labeled fragmented genomic DNA molecules causes mixing or shuffling such that redistribution to a second set of indexes is random, minimizing the possibility that multiple index-labeled fragmented genomic DNA molecules contain the same series of indexes that make up the unique label.

Example 2

Ligation-Mediated Bioinformatic Association of Nucleic Acid Ends in Emulsions for Mate-Pair Analysis Validation of Ligation in Emulsions A 34 bp adapter was designed. The adapter was biotinylated and A-tailed to force directionality of ligation. Ligation was performed in an tube or an emulsion using 50 ng of lambda DNA and 50 ng of adapter. Lambda DNA was used as it is unlikely to form circles. Droplets were created by standard techniques (e.g., flow focusing at a T-junction using a PDMS-based microfluidic chip). Channel 1 contained DNA in ligase buffer (500 microliters) and channel 2 contained Quick Ligase in ligase buffer (500 microliters). PCR primers were designed to amplify internally within the lambda DNA (ligation-independent) or to amplify a portion of the adapter and the 5' or 3' end of the lambda DNA (ligation-dependent). Negative controls were performed in tubes to ensure ligation was ligase-dependent.

Figure 2:
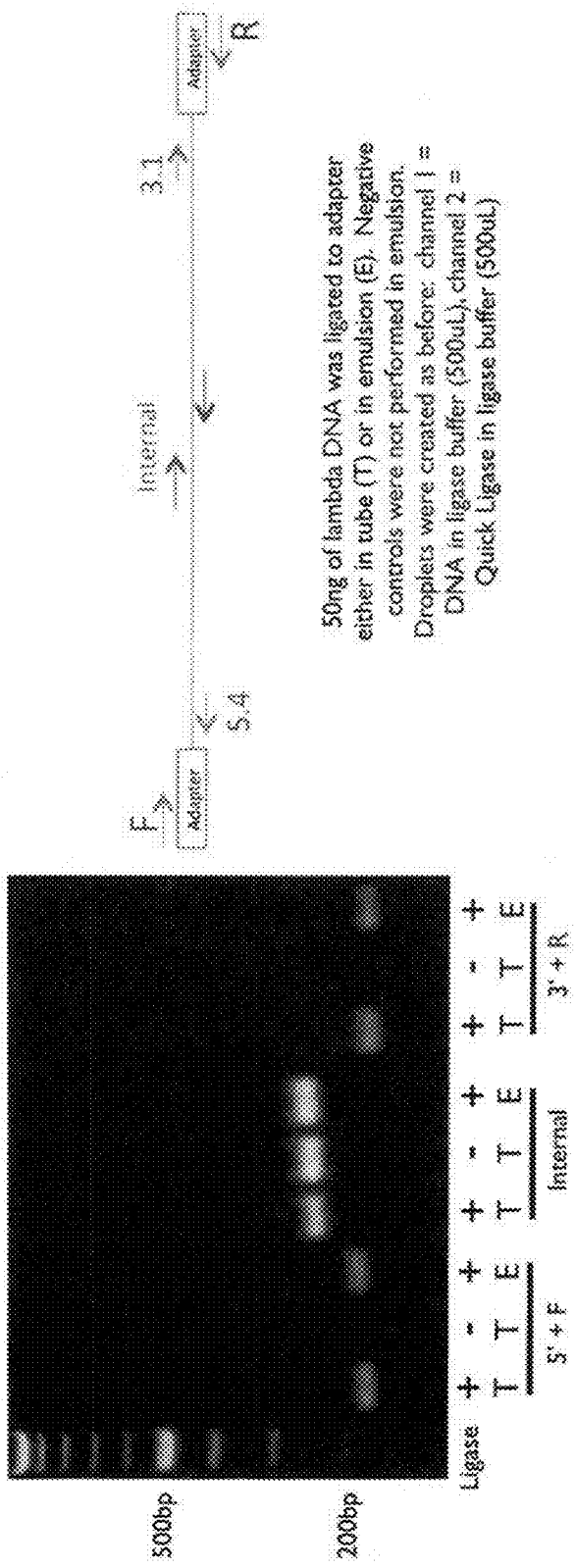
FIG. 2 is a gel electrophoresis showing ligation of an adapter sequence in either a tube (T) or an emulsion droplet (E).

FIG. 2 shows that ligation was achieved in both tubes and emulsion droplets, although ligation can also be achieved in other methods involving, for example, high-throughput plates. The forward primer for the adapter and the 5' primer for the lambda DNA only amplified in the presence of ligase, indicating that the adapter and the 5' end of the lambda DNA had ligated together in both tubes and emulsion droplets. The same result was achieved using the reverse primer for the adapter and the 3' primer for the lambda DNA, indicating that the adapter and the 3' end of the lambda DNA had ligated together in both tubes and emulsion droplets. These results demonstrate that ligation can be successfully performed in both tubes and emulsion droplets.

Generation of End-Labeled Genomic DNA Fragments

A method for bioinformatically associating the ends of genomic DNA is outlined in FIG. 3. Genomic DNA is fragmented and size selected to a known size using techniques known in the art as described in Example 1. The genomic DNA is then A-tailed and ligated to a biotinylated, T-tailed asymmetric oligonucleotide adapter using methods well known in the art as described in Example 1.

Multiple droplet libraries (preferably 2-4 libraries) are created such that each library contains approximately 1000 unique double-stranded oligonucleotide indexes, thus approximately 2000-4000 unique indexes are used. For a given library, each droplet will contain many copies of one unique double-stranded index. Droplets may contain some or all of the key components of a ligation reaction (e.g., MgCl$_2$, ATP, Ligase).

Fragmented genomic DNA ligated to an adapter is diluted to a desired concentration to control the number of molecules per droplet (e.g., a single DNA molecule per droplet or more than a single DNA molecule per droplet) and merged with the first index droplet library (Droplet Library "A" in FIG. 3).

A ligation reaction is performed in each droplet, joining each unique double-stranded oligonucleotide index to the adapter on each end of the genomic DNA. The emulsion is then broken and the DNA is phosphorylated so that a second index can be ligated to the end of the first index.

The process of fragmented genomic DNA dilution, merging with a droplet library (e.g. Droplet Library "B" or "C" in FIG. 3), ligation, breaking the droplets, and phosphorylation is repeated for the desired number of cycles, each time adding one new unique oligonucleotide index sequence to both ends of the fragmented genomic DNA.

After the final index addition, the result is fragmented genomic DNA uniquely end-labeled on both the 5' and 3' end with a unique label made up of many oligonucleotide indexes. The uniquely end-labeled fragmented genomic is then further fragmented and the ends are collected via streptavidin beads, which recognized the biotin label on the adapter. Fragments can be ligated to technology specific sequencing adapters (e.g., Illumina adapters) and sequenced. Ends are informatically paired by matching the unique label on one fragment of DNA with the same unique label on the other fragment of DNA as described in Example 1.

As with Example 1, this method can be used for other types of nucleic acids, such as RNA, cDNA, or PCR-amplified DNA, or any other type of construct where such a labeling scheme is required. Also as with Example 1, this method can be performed in well plates instead of emulsion droplets.

Validation of Ligation-Mediated End-Labeling

Three libraries were created "in bulk" in microcentrifuge tubes from fragmented, end-repaired, A-tailed E. coli genomic DNA. For all three libraries, an initial ligation reaction was performed to add on a generic adapter to the ends of the E. coli genomic DNA. Genomic DNA libraries were then subjected to 1 (Library 1), 2 (Library 2), or 3 (Library 3) rounds of index ligation. Index ligation was performed by joining unique double-stranded oligonucleotide indexes to the adapter on each end of the genomic DNA. If required, the DNA was phosphorylated so that a second index could ligated to the end of the first index (two rounds of index ligation) or a third index could be ligated to the end of a second index (three rounds of index ligation). For round 1 and round 3 of index ligation, the same library/pool of indexes was used (pool A). For round 2, a library/pool of different indexes was used (pool B). As a final step, Illumina indexed adapters were ligated to all three genomic DNA libraries. Libraries were then pooled and sequence on an Illumina MiSeq (Illumina, San Diego, Calif.) using standard Illumina sequencing primers. Paired reads were identified and analyzed en masse (i.e. data from read 1 (3' end read) and read 2 (5' end read) was analyzed together as a single population). Sequencing data was analyzed by breaking up the reads into four separate, linear 8-mer populations (i.e. positions 1 through 4 in the read), since the indexes were each 8 bp in length. For each position, the number of reads containing index or adapter were measured.

Figure 4:
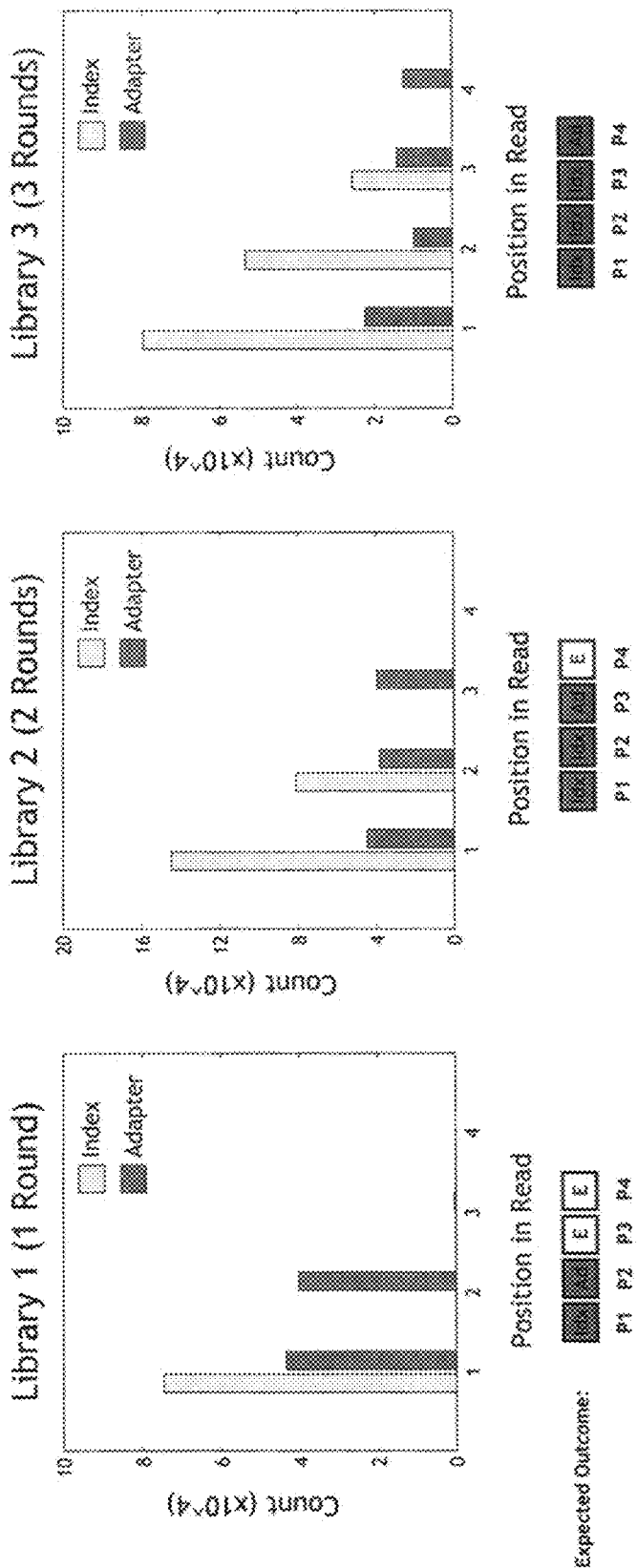
FIG. 4 provides bar graphs showing the results of 2-4 rounds of oligonucleotide tag attachment to demonstrate ligation efficiency.

FIG. 4 depicts the results of the total read population analysis (i.e., en masse analysis) of the index ligation method. Library 1, which underwent 1 round of index ligation, had an expected outcome of an index read in position 1 and an adapter read in position 2. Library 2, which underwent 2 rounds of index ligation, had an expected outcome of an index read in position 1 and 2 and an adapter read in position 3. Library 3, which underwent 3 rounds of index ligation, had an expected outcome of an index read in position 1 to 3 and an adapter read in position 4.

Figure 5A:
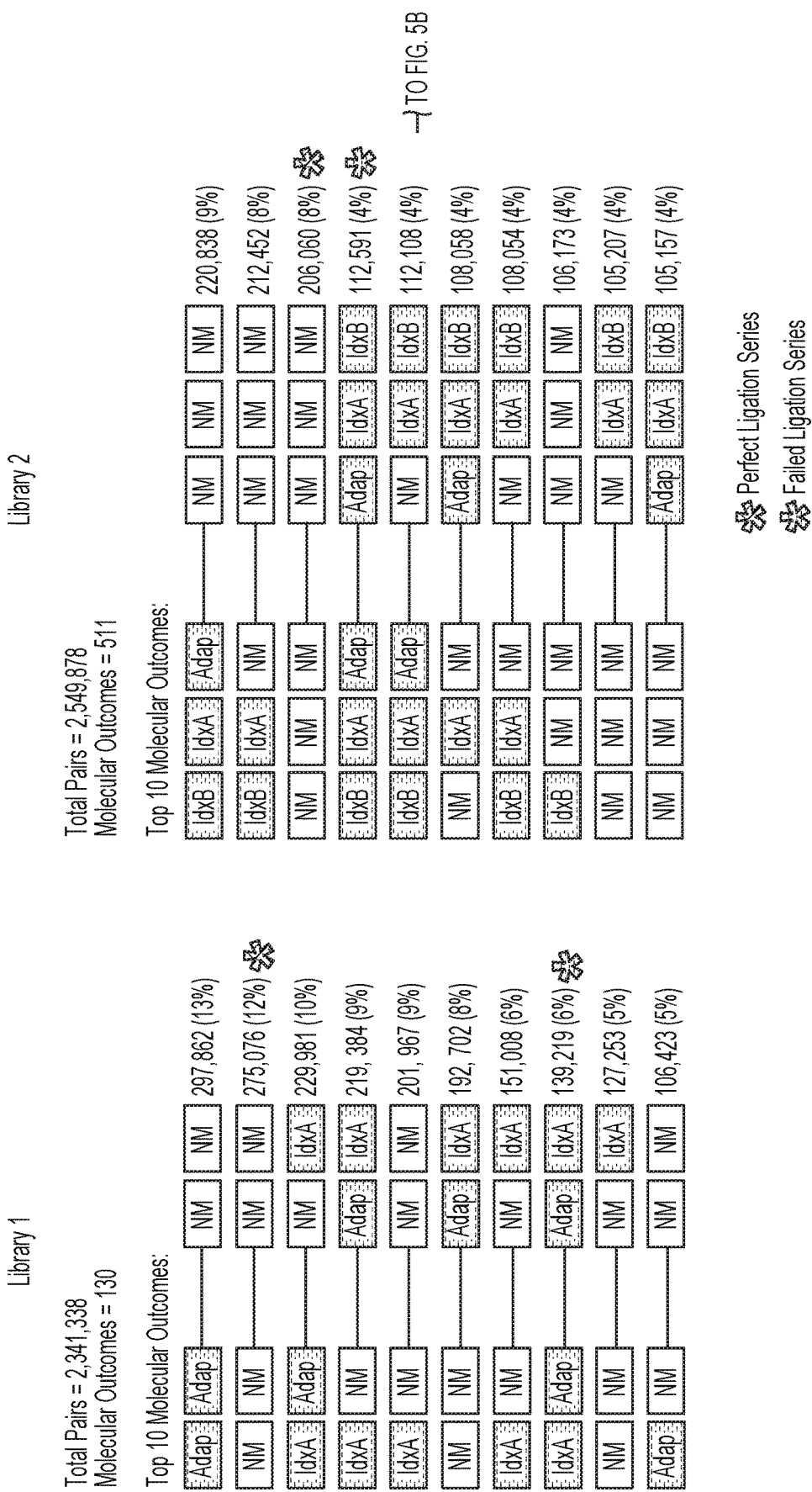
FIG. 5A-5B shows various end products from a labeling synthesis as well as the frequency of each end product, including desired and spurious end products.
Figure 5B:
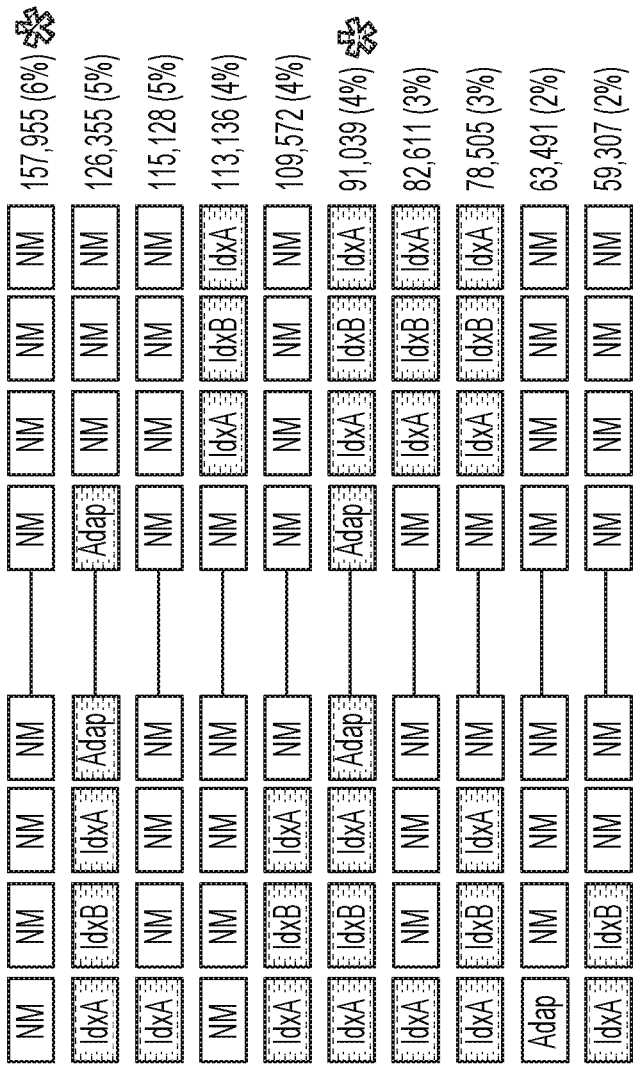

FIG. 5 depicts the results of read pair analysis of individual molecules that underwent the index ligation method. Instead of analyzing the data from read 1 (3' end read) and read 2 (5' end read) together, reads were paired so that a molecule-by-molecule analysis was performed. First, reads were paired based on their unique read identifier. Each read was then broken down into 4 positions (8-mers) per read as described above. For each library, the total number of read pairs and the total number of unique molecular outcomes were determined and are shown in FIG. 5. The composition of the top 10 most prevalent molecular outcomes and the number of pairs for each outcome are also shown in FIG. 5. It was determined that the most desired outcome (the correct expected outcome) occurred 6% of the time in Library 1, 4% of the time in Library 2, and 4% of the time in Library 3.

Thus, FIGS. 4 and 5 show that the expected outcome was achieved and thus index ligation is a valid method of generating a unique label.

Example 3

Figure 6A:
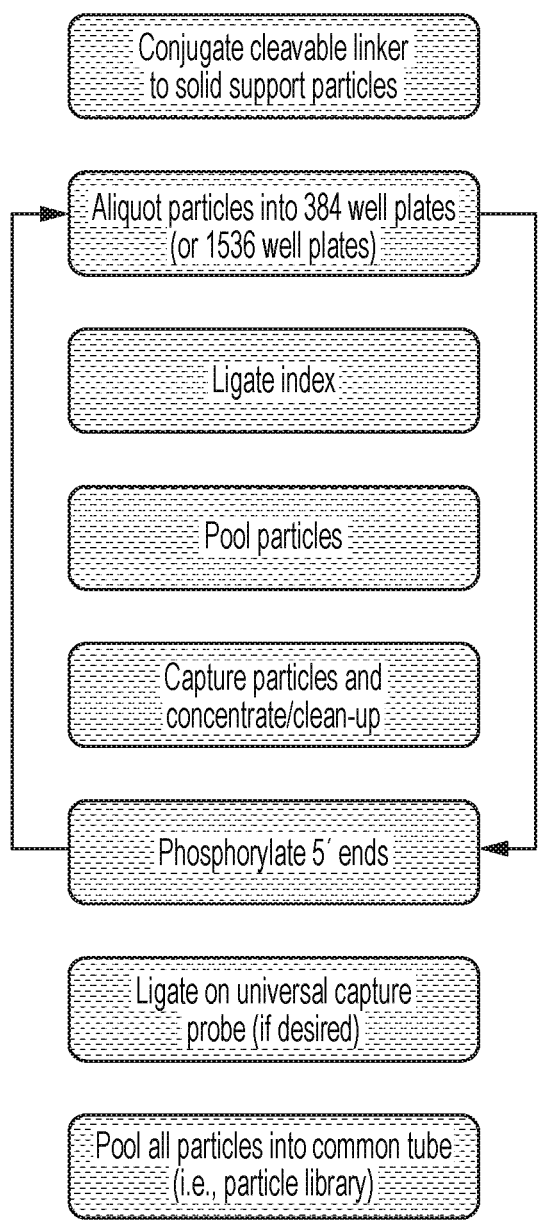
Figure 6B:
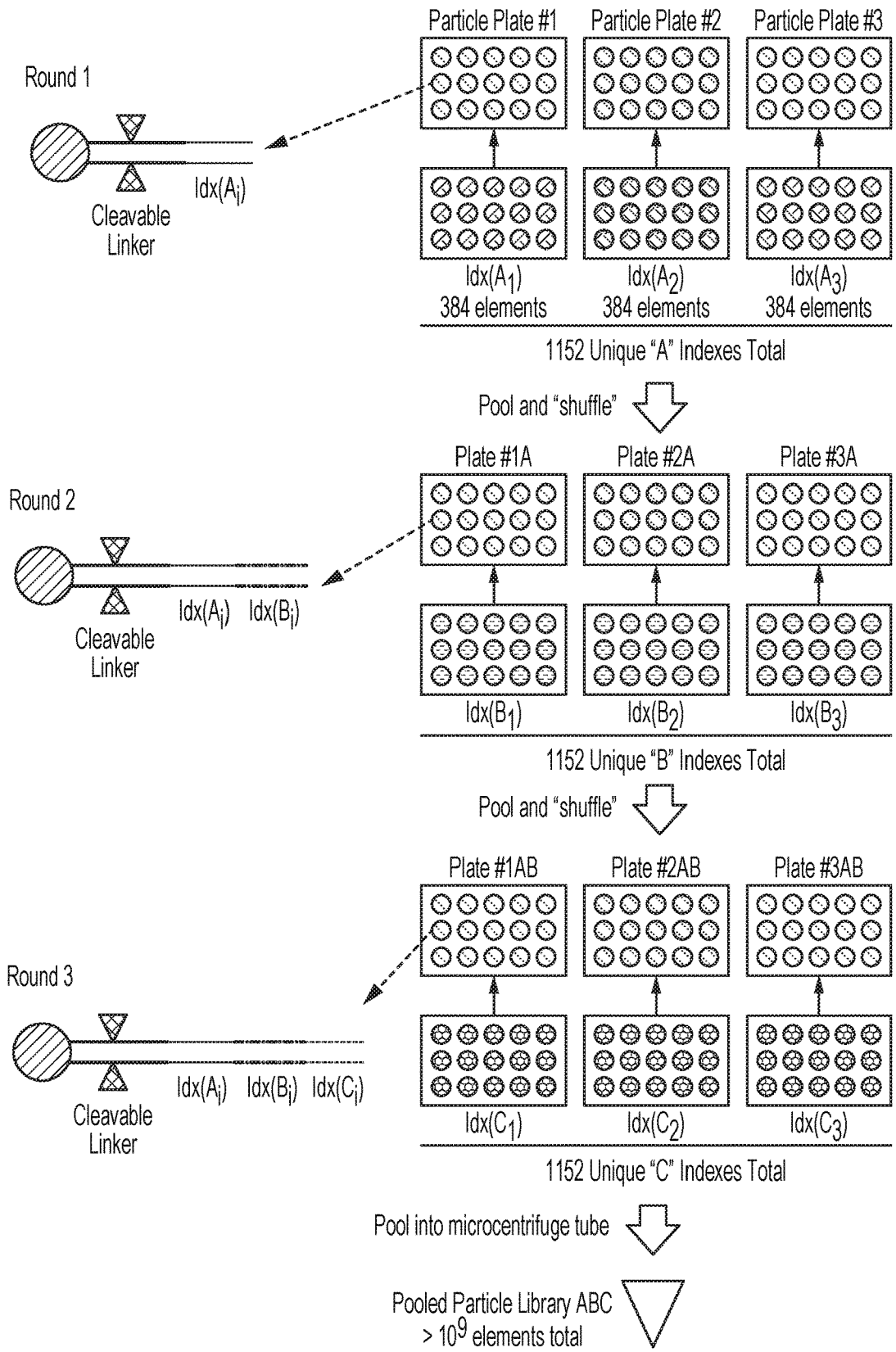

Ligation-Mediated Oligonucleotide-Based Unique Labels Attached to Solid Supports Solid support particles (e.g. beads or a polymer) are purchased or provided and conjugated to a cleavable linker (photo- or chemically cleavable). Each solid support has a vast number of binding sites on its surface. FIG. 6 shows a single binding site on a bead for illustrative purposes. The cleavable linker in FIG. 6 shows a double-stranded DNA (dsDNA) linker, but the cleavable linker can be any substrate that supports the covalent addition of a dsDNA.

Arrays of dsDNA oligonucleotide indexes are prepared in 384-well (or 1536-well) plates. 2 to 4 index arrays are created, each containing ~1000 unique indexes for a total of ~2000-4000 unique indexes.

Solid supports are aliquoted into 384-well (or 1536-well) plates at a desired density. Using a liquid handling robot, ligase buffer and ligase enzyme are added to the solid support plates. An aliquot of index array "A" is then added to the plates (FIG. 6).

Following ligation of the "A" index to the solid supports, solid supports are pooled using a liquid handling robot, collected (e.g., using a standard magnet for paramagnetic beads or a centrifuge for beads or polymers), and washed to remove unwanted material.

A kinase reaction is then performed in order to permit the addition of the next index.

Solid supports are then resuspended and aliquoted into 384-well (or 1536-well) plates at a desired density. This mixing or shuffling randomly redistributes the solid supports, minimizing the possibility that multiple solid supports contain the same series of indexes that make up the unique label.

Index ligation is repeated 2-4 times. For example, the above steps are repeated with index array "B" and then again with index array "C" as illustrated in FIG. 6. Upon completion of this method, uniquely-labeled solid supports are generated, wherein each solid support has multiple copies of the same unique label made up of an index A sequence, an index B sequence, and an index C sequence but has a different unique label than other solid supports. The mixing and redistribution of the solid supports after each addition of an index sequence makes it unlikely that two solid supports will carry the same unique label. To illustrate this, after 3 successive rounds of index ligation, the population of solid supports can accommodate >$10^9$ unique labels.

The uniquely-labeled solid supports can then be further modified to include a capture oligo (e.g., oligo-dT or a sequence specific capture probe). Alternatively, the uniquely-labeled solid supports can be used "as is" for ligation or binding of agents DNA, RNA, cells, polymers, proteins, etc.).

This method, for example, can be performed in common plastic ware (e.g. well plates) or emulsion droplets.

Figure 7:
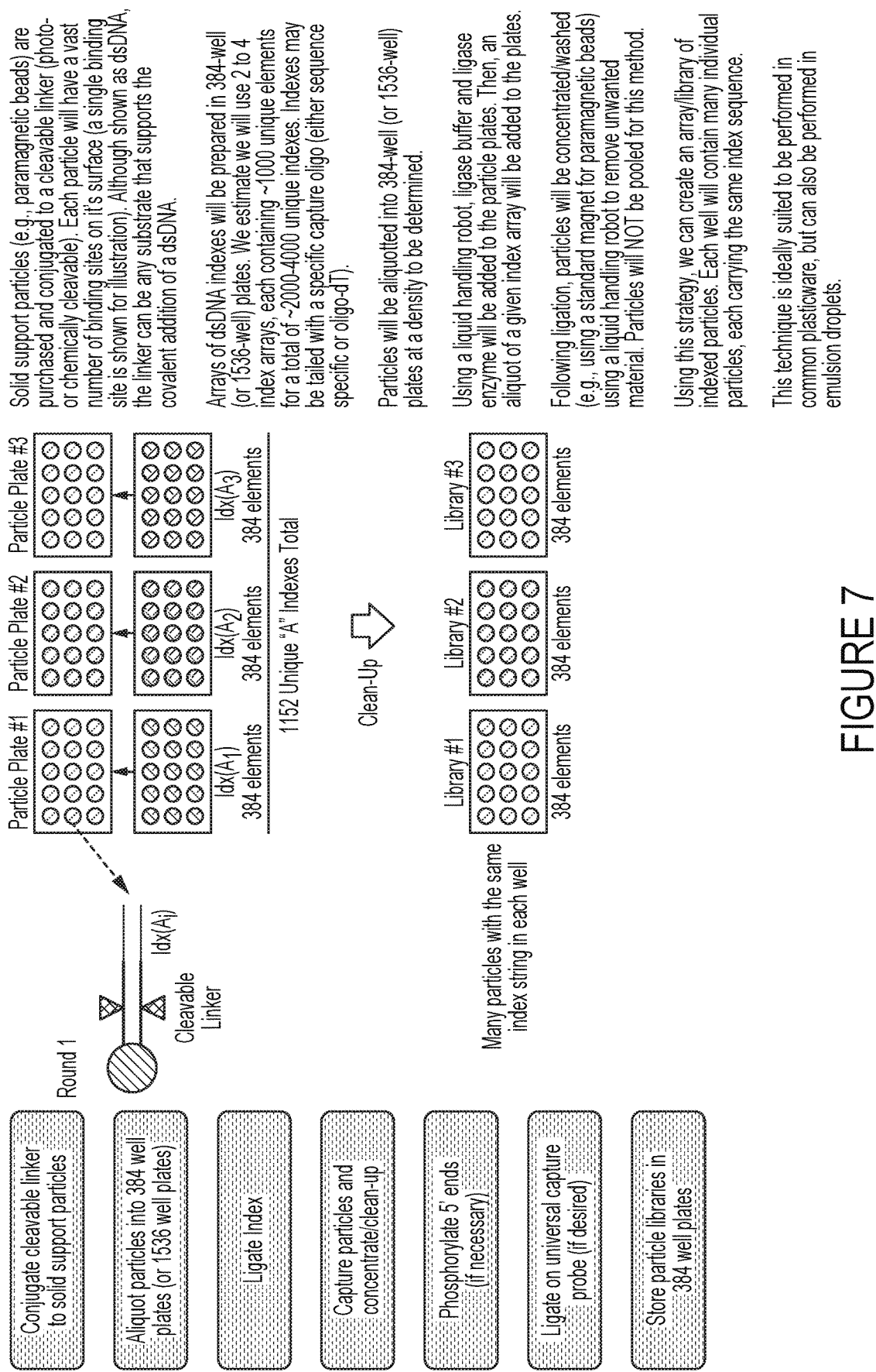
FIG. 7 is a schematic of a plate-based approach to the generation of several pluralities of particles, wherein all the particles within a plurality are identically labeled.

This method can be also adapted to create discrete libraries of uniquely labeled solid supports as shown in FIG. 7. Indexes and solid supports aliquoted into well plates as described above. Index array "A" is added to each plate of solid supports and ligated to the solid supports. A liquid handling robot is used to wash the solid supports and remove unwanted material. Solid supports are not pooled, but instead are kept separate. Index array "B" is then added to each plate of solid supports and ligated to the solid supports. This is repeated with Index array "C". This method generates many solid supports with the same unique label contained within the same well. This method, for example, can be performed in common plastic ware (e.g. well plates) or emulsion droplets.

Example 4

Microbiome Typing Using Unique Labels

Figure 8A:
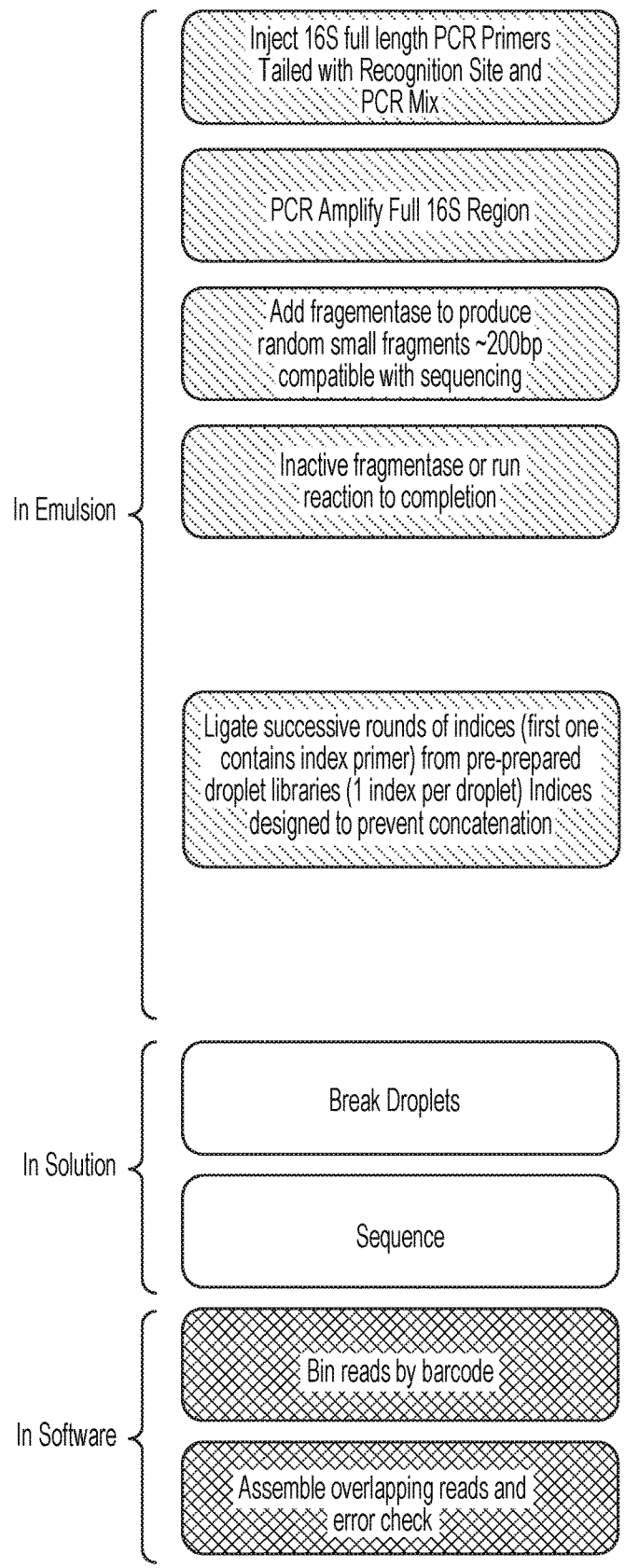
FIG. 8A-8C is a schematic illustrating application of the labeling strategies of the invention to amplified fragments from the 16S region of a microbe.
Figure 8B:
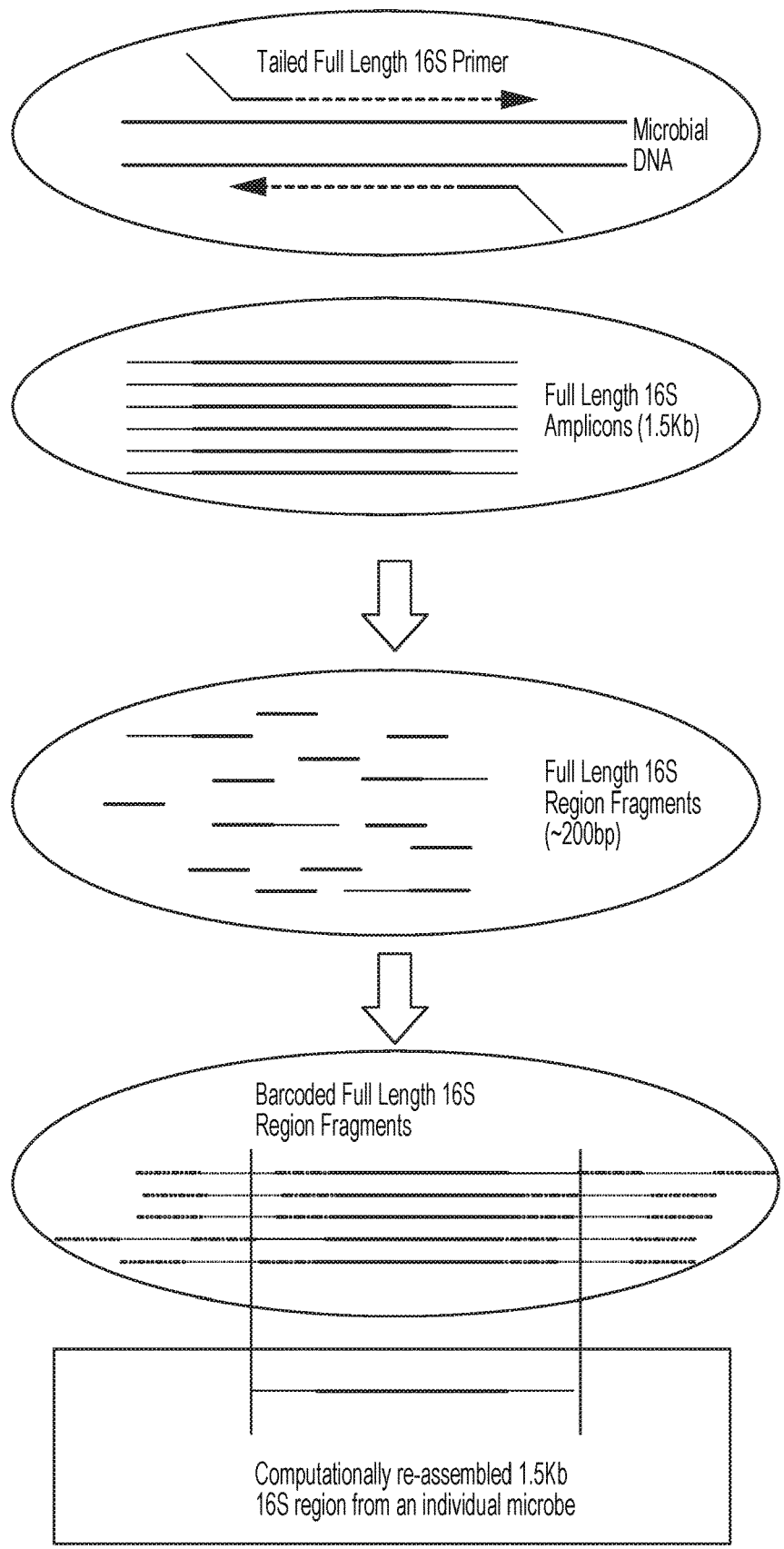
Figure 8C:
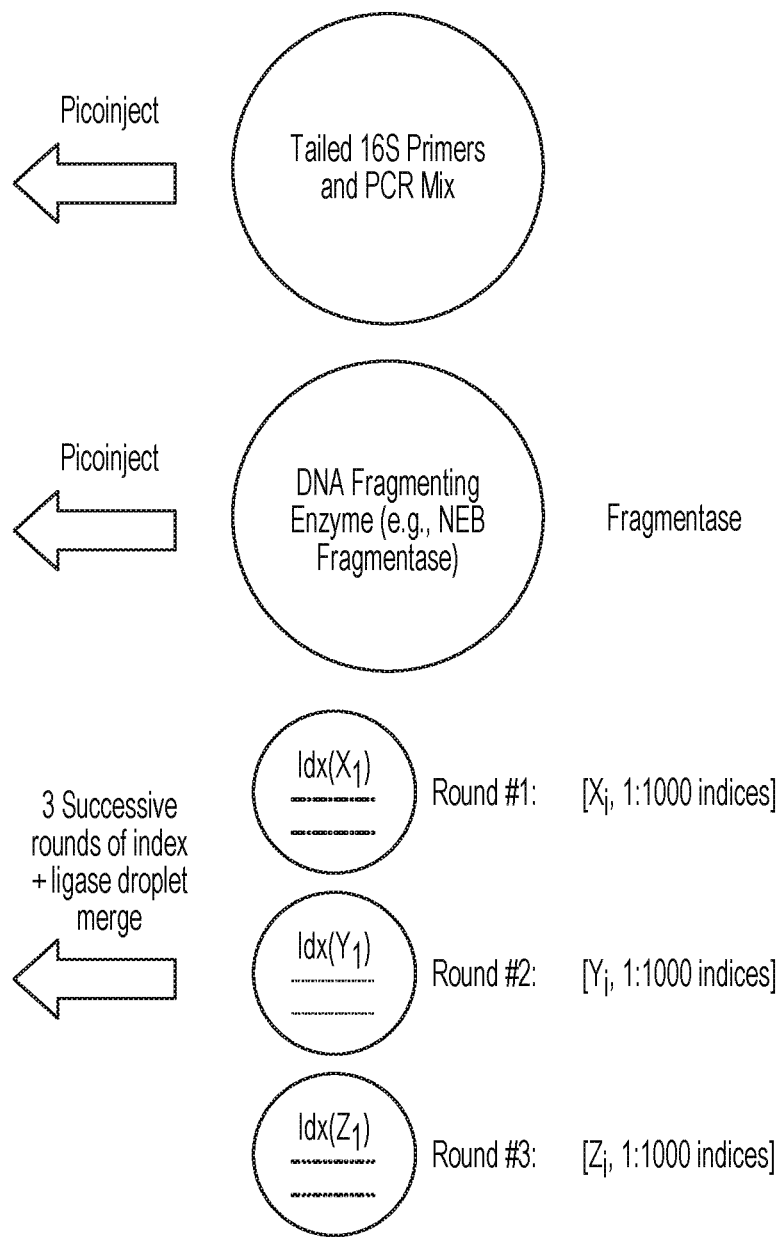

FIG. 8 depicts an exemplary method for identifying multiple species of bacteria contained within a microbiome. A microbiome sample is isolated (e.g. from the gut of an animal or from a sample in the environment such as a water source) as is known in the art. Individual cells are suspended in emulsions and lysed by methods known in the art (e.g., chemical lysis).

16S rRNA primers tailed with a recognition site (in order to identify the ends of the 16S rRNA gene after sequencing) and PCR mix are picoinjected into each emulsion droplet in order to amplify the full-length 16S rRNA gene. The 16S rRNA gene has been used previously for phylogenetic studies as it is highly conserved between different species of bacteria and archaea. Universal primers are used to amplify the 16S rRNA gene from different species (e.g. 27F and 1492R or 27F and 534R from Weisburg, Barns, Pelletier and Lane. 16S ribosomal DNA amplification for phylogenetic study. J. Bacteriol. January 1991 vol. 173 no. 2 697-703). 16S rRNA gene sequences contain hypervariable regions that provide species-specific signature sequences useful for bacterial identification. After amplification, a DNA fragmenting agent (e.g., Fragmentase® from New England BioLabs Inc., Ipswich, Mass.) is added to produce random small fragments compatible with current sequencing technology (e.g., approximately 200 bp). Fragmentase® is inactivated by addition of 0.5 M EDTA, by heat inactivation, or by allowing the reaction to run to completion.

3 rounds of index ligation are performed as described in Example 2 to label all of the 16S fragments contained within a single emulsion droplet with the same label containing 3 indexes. In this method, each all of the fragments in each droplet will be identically labeled compared to each other but uniquely labeled compared to fragments contained in other droplet.

After completion of the index ligation, the emulsion droplets are broken and the 16S fragments pooled. The 16S fragments from multiple different microbes can then be sequenced at the same time. Sequencing is performed on standard commercial machines as is known in the art, e.g., Illumina Sequencing (Illumina, San Diego, Calif.).

The sequencing reads are then binned according to the common unique label "barcode" and a "mini-assembly" of the region from overlapping regions and known ends (from the recognition site on the primers) is performed. Thus, a computational re-assembly of the 1.5 Kb 16S region is performed from individual microbes.

Example 5

Other Methods of Generating Unique End-labeled Nucleic Acids

The following methods describe addition of one or two index sequences to create a unique end-labeled nucleic acid. It is to be understood that more than one or two index sequences can be added by repeating the steps required to add an additional index sequence. As a result, a unique end-labeled nucleic acid could have three or more index sequences per unique label.

Figure 9A:
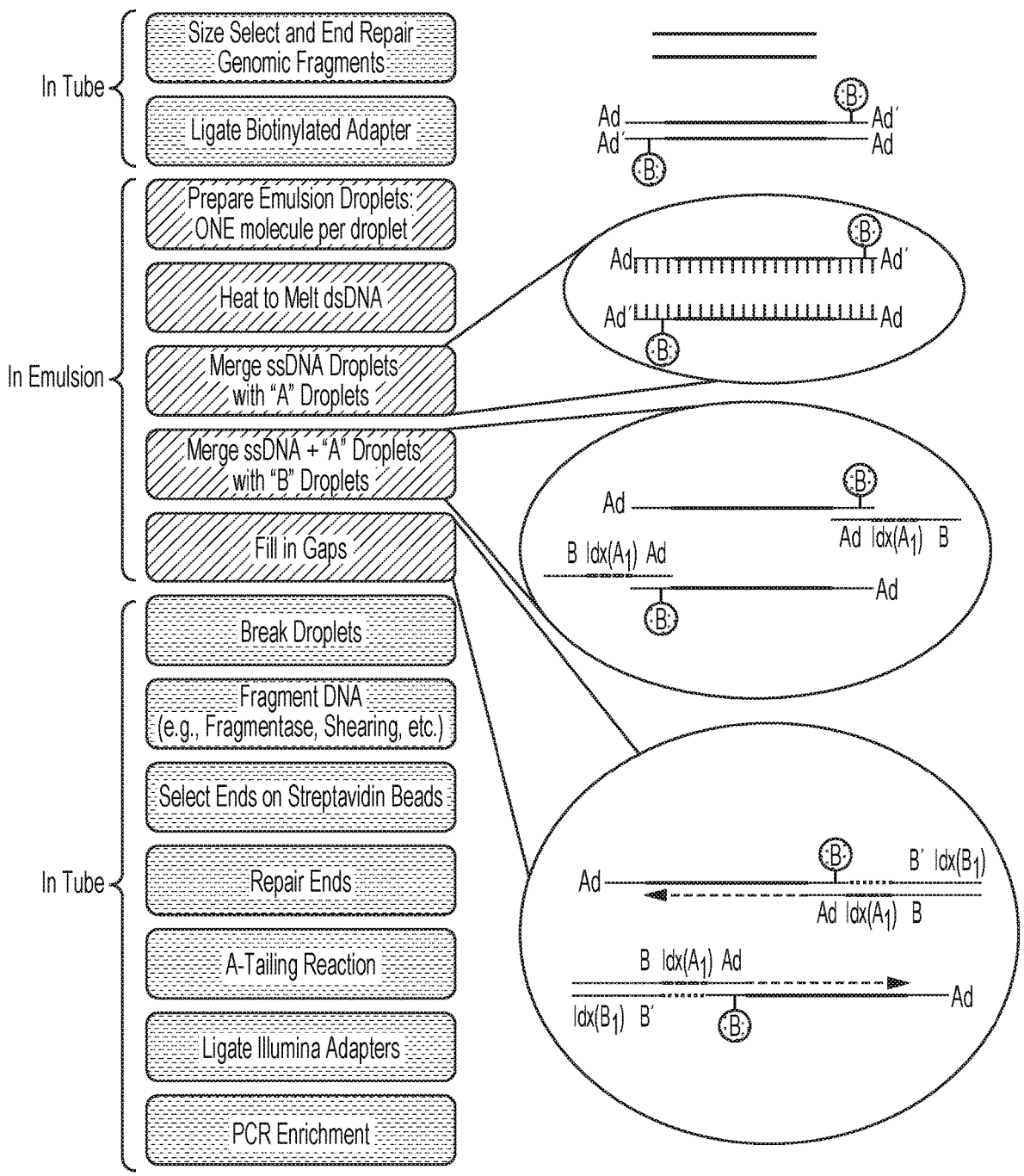
FIG. 9A-9B is a schematic of a mate pair synthesis process using single stranded genomic DNA as the agent. Each droplet may comprise both strands of the genomic fragment. As shown in the Figure, the strands are identically labeled at one end.
Figure 9B:
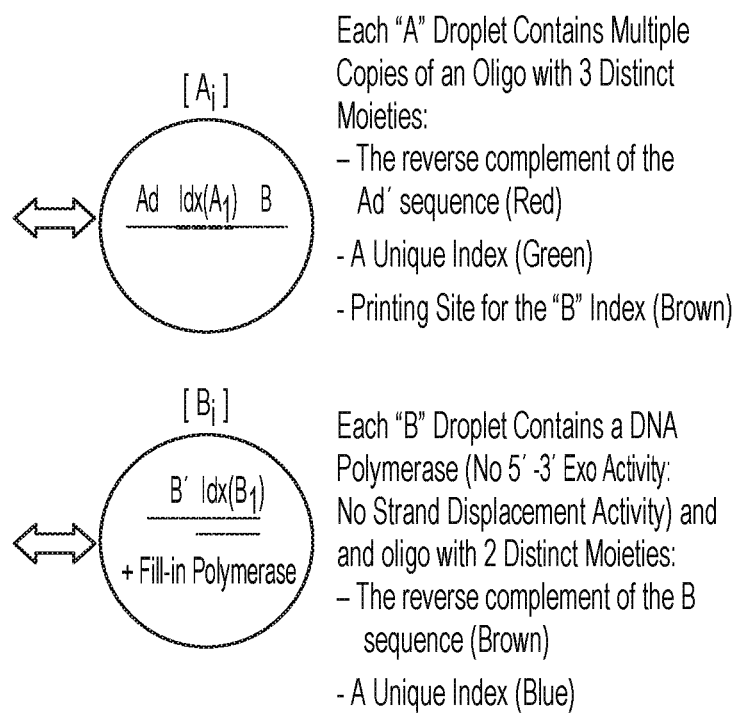

FIG. 9 depicts a method using polymerase and single-stranded index oligo sequences. Genomic fragments, size selected are generated and ligated to an adapter as described in Example 1. Emulsion droplets are prepared with one genomic fragment ligated to an adapter per droplet. The genomic fragment is melted (e.g., by heating the double stranded fragment to produce two single stranded fragments) and each droplet is merged with an "A" droplet that contains multiple copies of a single stranded oligonucleotide index "$A_i$". Each "$A_i$" single stranded index includes three distinct sequence moieties: 1) the reverse complement of the adapter sequence, 2) a unique index sequence, and 3) a priming site for the next single stranded oligonucleotide index. The single stranded oligonucleotide index "$A_i$" hybridizes to the adapter attached to the genomic fragment in each merged droplet. Each merged droplet is then merged with a "B" droplet that contains multiple copies of a single stranded oligonucleotide index "$B_i$". Each "$B_i$" single stranded index includes two distinct sequence moieties: 1) the reverse complement of the priming site in "$A_i$" and 2) a unique index sequence. Each "B" droplet also contains a polymerase, preferably one without 5'-3' exonuclease activity and without strand displacement activity. The single stranded oligonucleotide index "$B_i$" hybridizes to the "$A_i$" index attached to the genomic fragment in each doubly merged droplet. The polymerase is then used to fill in the gaps to create double stranded genomic fragments, wherein the end of each genomic fragment is tagged with the same distinct combination of A/B indexes and wherein each droplet contains a unique combination of A/B indexes compared to other droplets. The uniquely end-labeled fragmented genomic DNA is then further fragmented and the ends are collected via streptavidin beads, which recognized the biotin label on the adapter. Fragments can be ligated to technology specific sequencing adapters (e.g., Illumina adapters) and sequenced. Ends are informatically paired by matching the unique label on one fragment of DNA with the same unique label on the other fragment of DNA as described in Examples 1 and 2.

Some methods of the invention use picoinjection of single molecules of fragmented genomic DNA into droplet that contain index sequences. Genomic DNA is fragmented, size selected and ligated to a biotinylated adapter as described in Example 1 and diluted sufficiently to allow picoinjection of a single genomic fragment by picoinjection. An emulsion droplet library "A" is created as described above. Each "A" droplet contains a ligase plus multiple copies of an "A" index oligonucleotide. Each "A" index oligonucleotide contains a unique index sequence and a single-stranded priming site for a "B" index oligonucleotide. Each "A" droplet is picoinjected with a single molecule of fragmented genomic DNA using methods known in the art (see, e.g., High-Throughput Injection with Microfluidics Using Picoinjectors. A. R. Abate, T. Hung, P. Mary, J. J. Agresti, and D. A Weitz. PNAS 107, 19163-19166 (2010)). The "A" index oligonucleotide is ligated to the adapter on each fragmented genomic DNA molecule. The droplets are then broken as described in Example 1 and diluted sufficiently to allow picoinjection of a single genomic fragment molecule attached to an "A" index into the next emulsion droplet library. An emulsion droplet library "B" is created. Each "B" droplet contains a ligase plus multiple copies of a singled stranded "B" index oligonucleotide. Each "B" index contains the reverse complement to the priming site on the "A" index and a unique index sequence. Each "B" droplet is picoinjected with a single genomic fragment molecule attached to an "A" index. The "B" index is then ligated to the "A" index. The droplets are then broken and the ends are filled in using a polymerase. The result is uniquely end-labeled fragmented genomic DNA, wherein each end is labeled with the same "A" and "B" index. The uniquely end-labeled fragmented genomic DNA is then further fragmented and the ends are collected via streptavidin beads, which recognized the biotin label on the adapter. Fragments can be ligated to technology specific sequencing adapters (e.g., Illumina adapters) and sequenced. Ends are informatically paired by matching the unique label on one fragment of DNA with the same unique label on the other fragment of DNA as described in Examples 1 and 2.

Figure 10A:
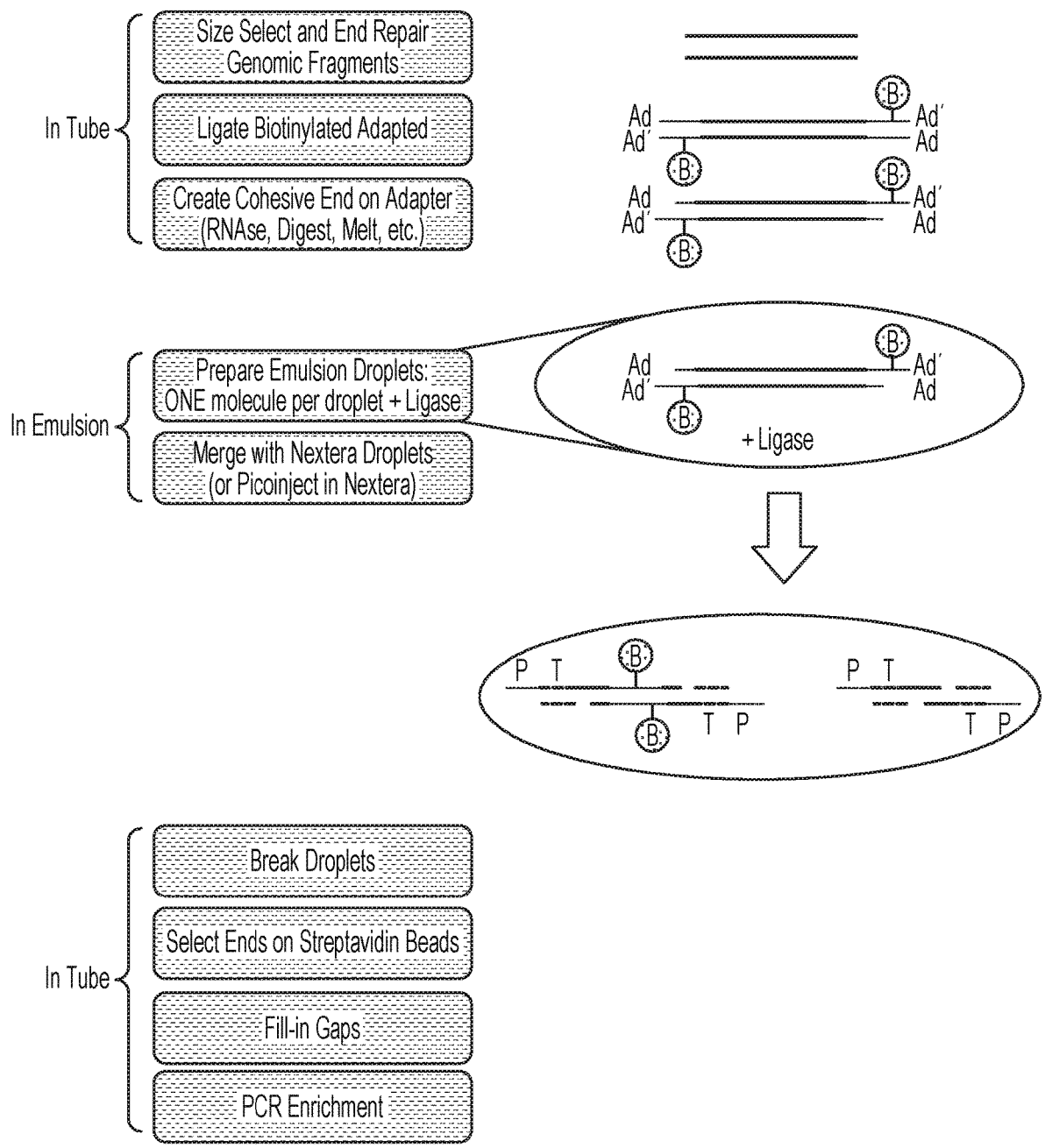
FIG. 10A-10B is a schematic of a mate pair synthesis using droplets and Nextera transposomes as detectable tags.
Figure 10B:
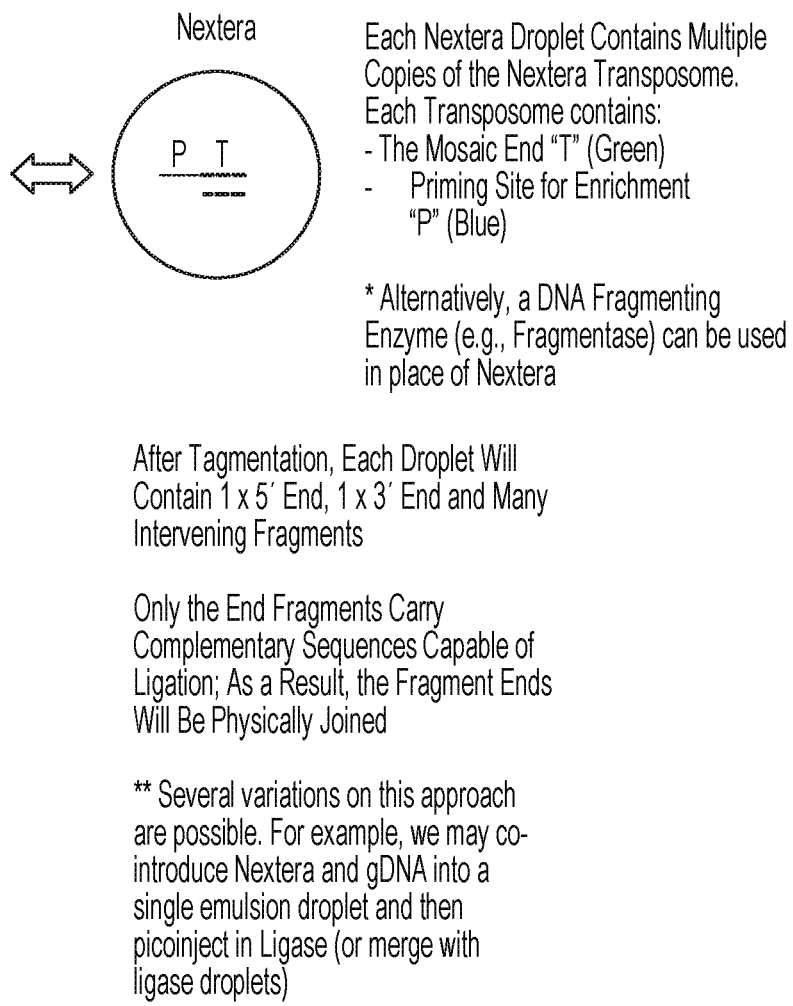

FIG. 10 describes a method using a DNA fragmenting enzyme or a transposome (e.g., Nextera™ from Illumina, San Diego, Calif.). Genomic DNA is fragmented, size selected and ligated to a biotinylated adapter as described in Example 1. A cohesive end is produced on the adapter using methods known in the art (e.g., a nuclease or a restriction enzyme) such that the two adapters on each genomic fragment can be ligated together. Emulsion droplets are prepared as described in Example 1. Each droplet contains ligase and one molecule of fragmented genomic DNA. These emulsion droplets are then merged with Nextera™ droplets (or alternatively picoinjected with Nextera™). Nextera™ is a transposome that contains a modified transposase that simultaneously fragments DNA and tags the fragmented DNA with an oligonucleotide (referred to as "tagmentation"). The oligonucleotide can be an index oligonucleotide that contains a unique index sequence and a priming site. The priming site can be used either for enrichment after tagmentation or for attaching an additional index sequence after tagmentation. Following tagmentation, each droplet contains a 5' genomic fragment attached to a biotionylated adapter and an index oligonucleotide, a 3' genomic fragment attached to a biotinylated adapter and an index oligonucleotide, and several intervening fragments attached to index oligonucleotides. Only the fragments carrying the adapters can ligate to each other, so only the 5' and 3' genomic fragments will ligate together. The ligated 5' and 3' genomic fragments are then be purified away from the intervening fragments using selection on streptavidin beads. The ligated 5' and 3' genomic fragments can then be amplified using the priming site or further index oligonucleotides can be added as described in the above examples in order to create ligated 5' and 3' genomic fragments that are uniquely labeled with multiple index sequences. Fragments can be ligated to technology specific sequencing adapters (e.g., Illumina adapters) and sequenced. Ends are informatically paired by matching the unique label on one fragment of DNA with the same unique label on the other fragment of DNA as described in Examples 1 and 2. This method can also be carried out using fragmentase, index oligonucleotides, and ligase in place of Nextera™.

Example 6

Forked Adapters

Figure 11:
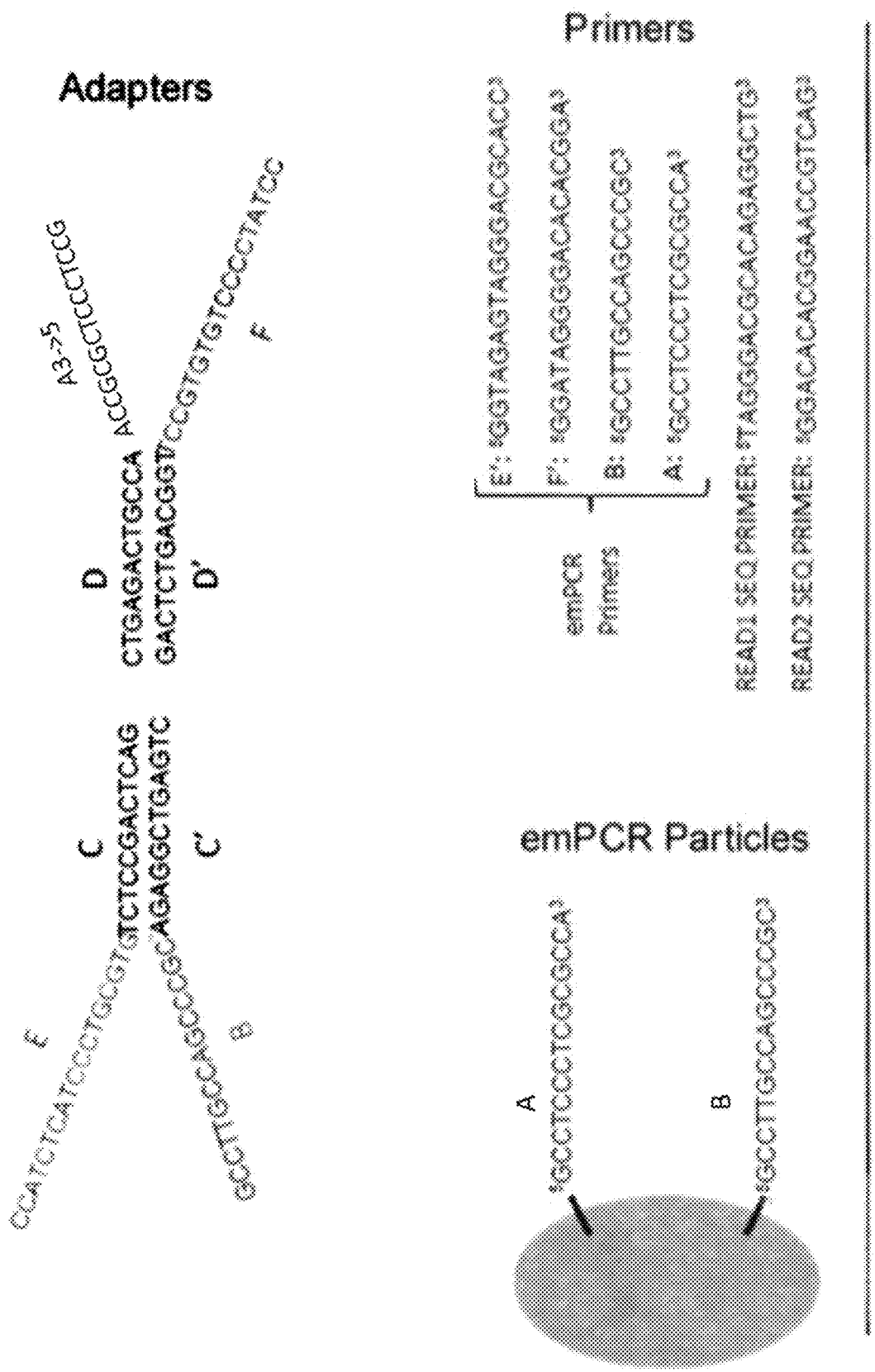
FIG. 11 is a schematic illustrating the use of forked adapters.
Figure 11:
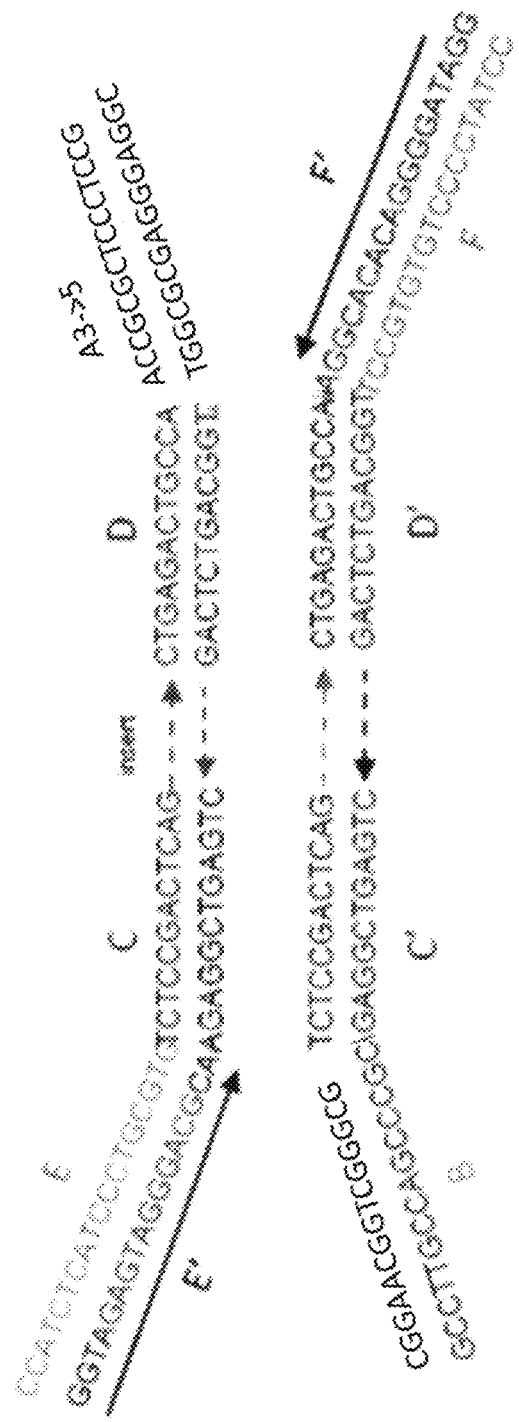
Figure 11:
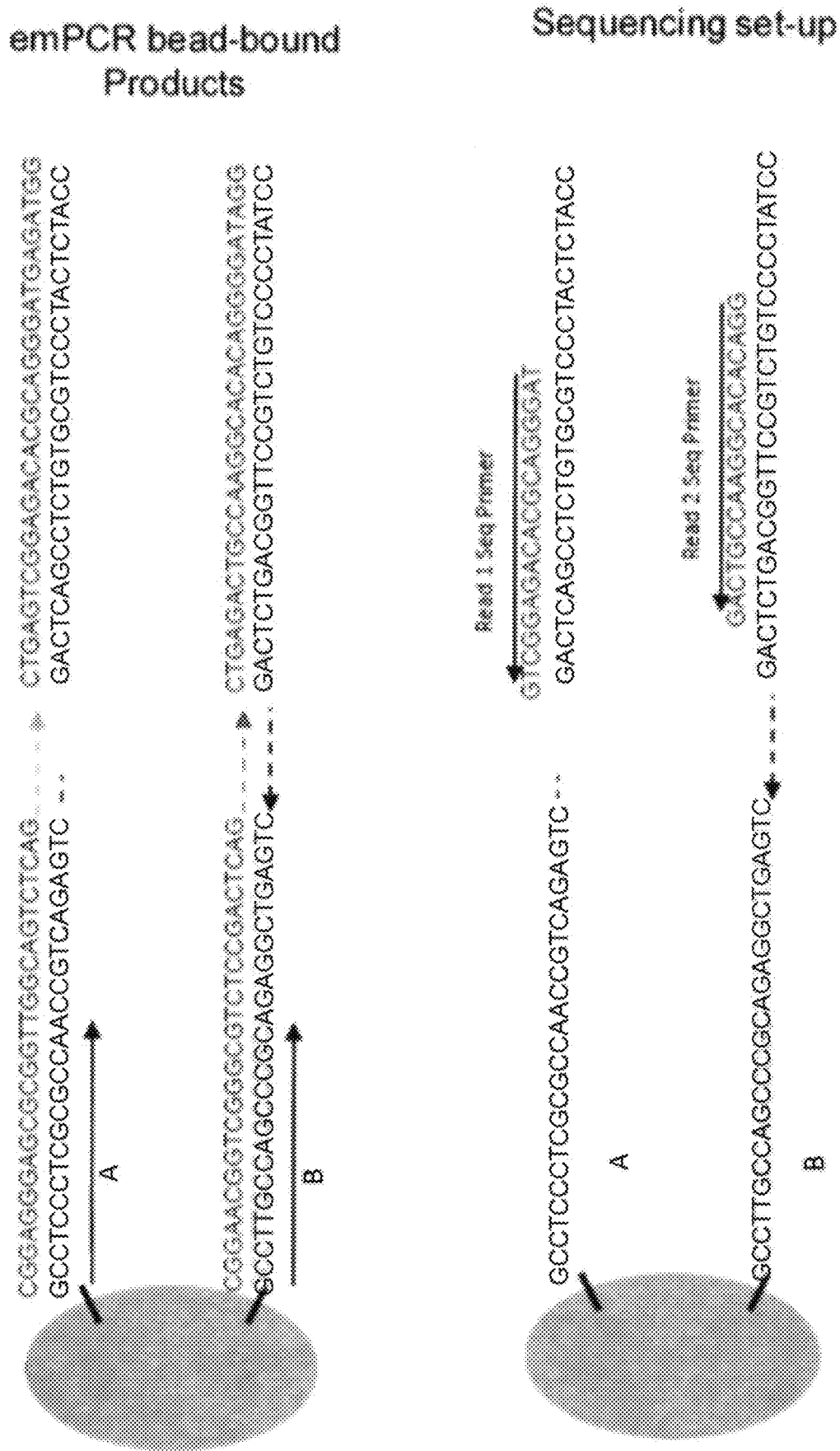

FIG. 11 depicts a pair of forked adapters for use in the invention or in other unrelated applications. The ability to produce sequence reads from distal ends of a single DNA fragment (paired-end sequencing) is extremely useful for many downstream analyses. Currently there are no commercially available methods for effective paired-end sequencing from beads on any of the established bead-based sequencing technologies (e.g., AB Solid, Roche/454 and Ion Torrent).

The method outlined briefly herein uses a pair of specially designed forked oligonucleotide adapters to tail a double-stranded DNA fragment such that once amplified in emulsion PCR, each strand of the original fragment is amplified on to the surface of the bead. Once both strands of DNA are present on the bead two distinct sequencing reactions can be performed to read the sequence at either end of the fragment.

Figure 12:
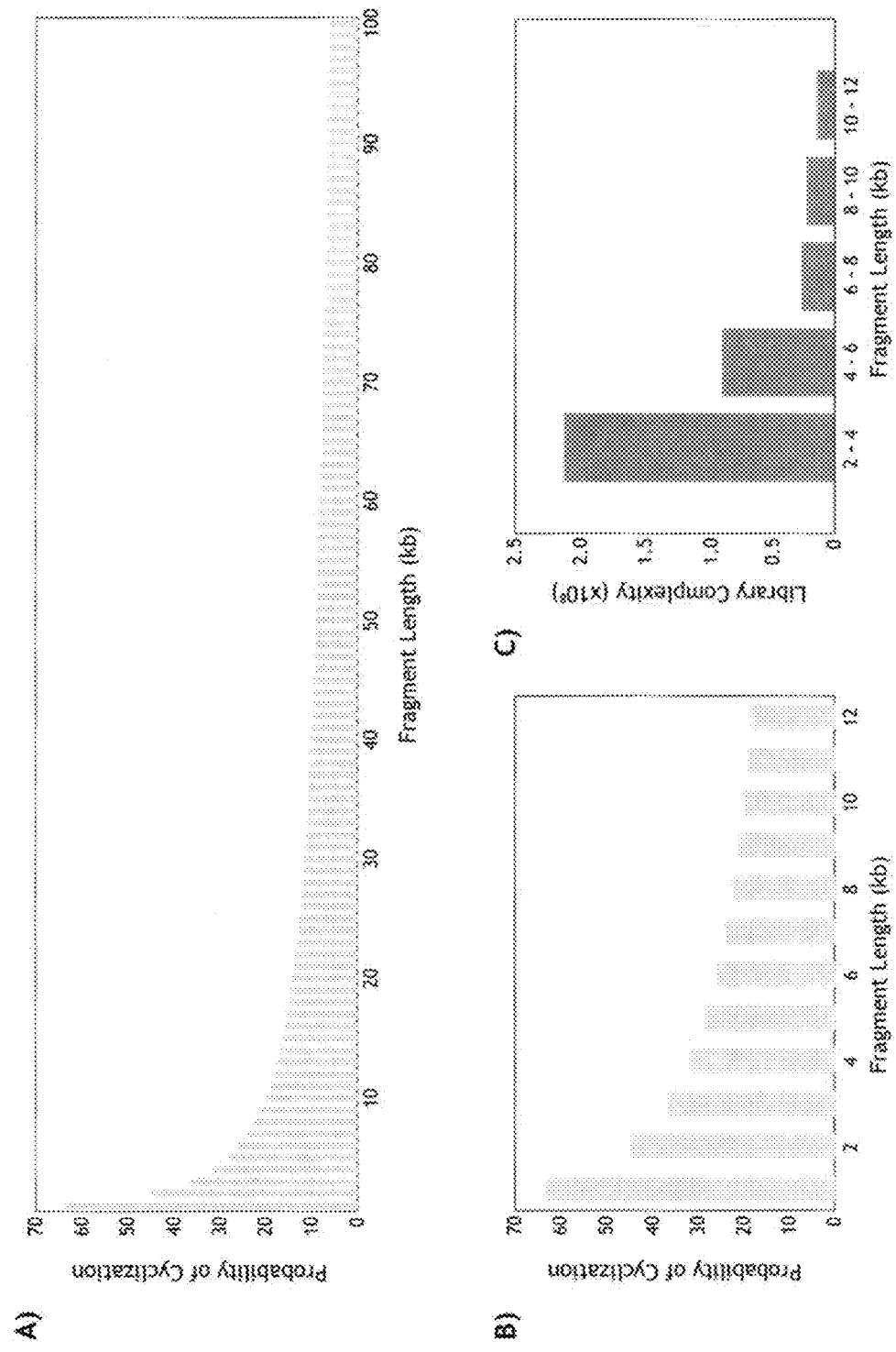
FIG. 12 shows that the efficiency of DNA circularization (cyclization) decreases as fragment length increases.
Figure 13A:
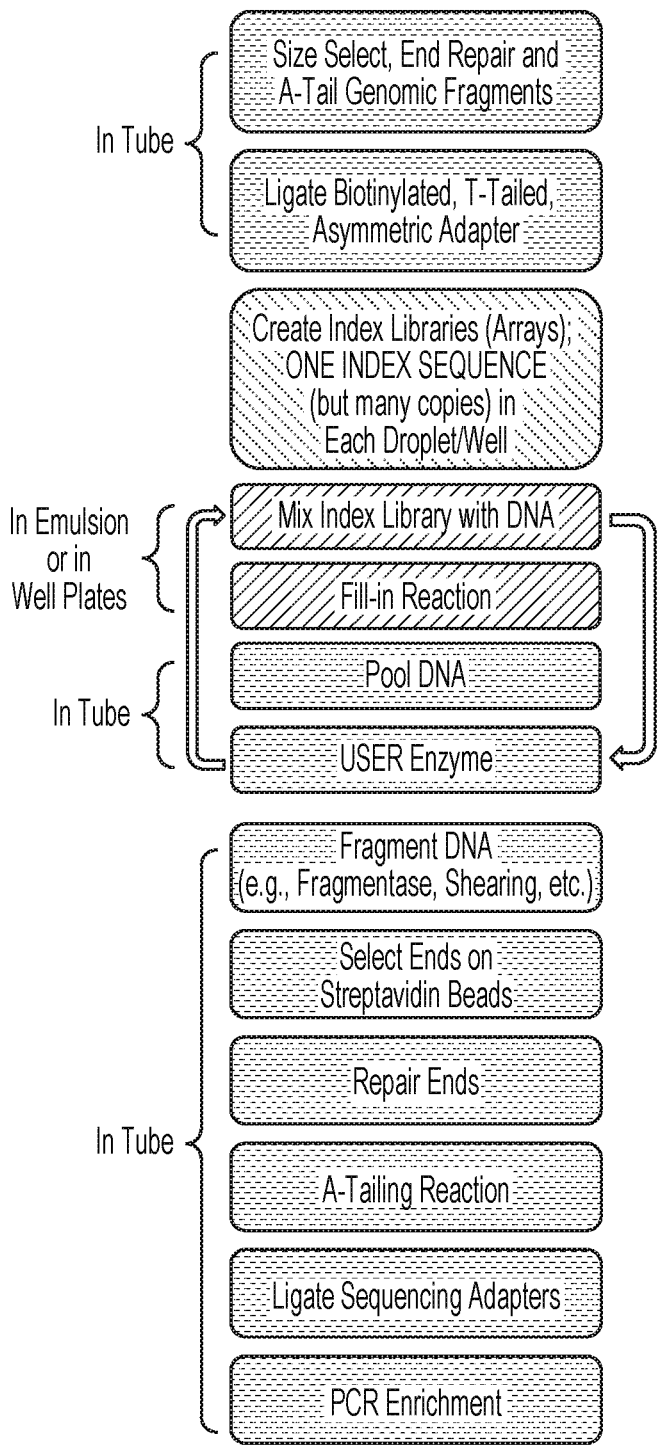
FIG. 13A-13B is a schematic depicting the technique for polymerase mediated index addition.
Figure 13B:
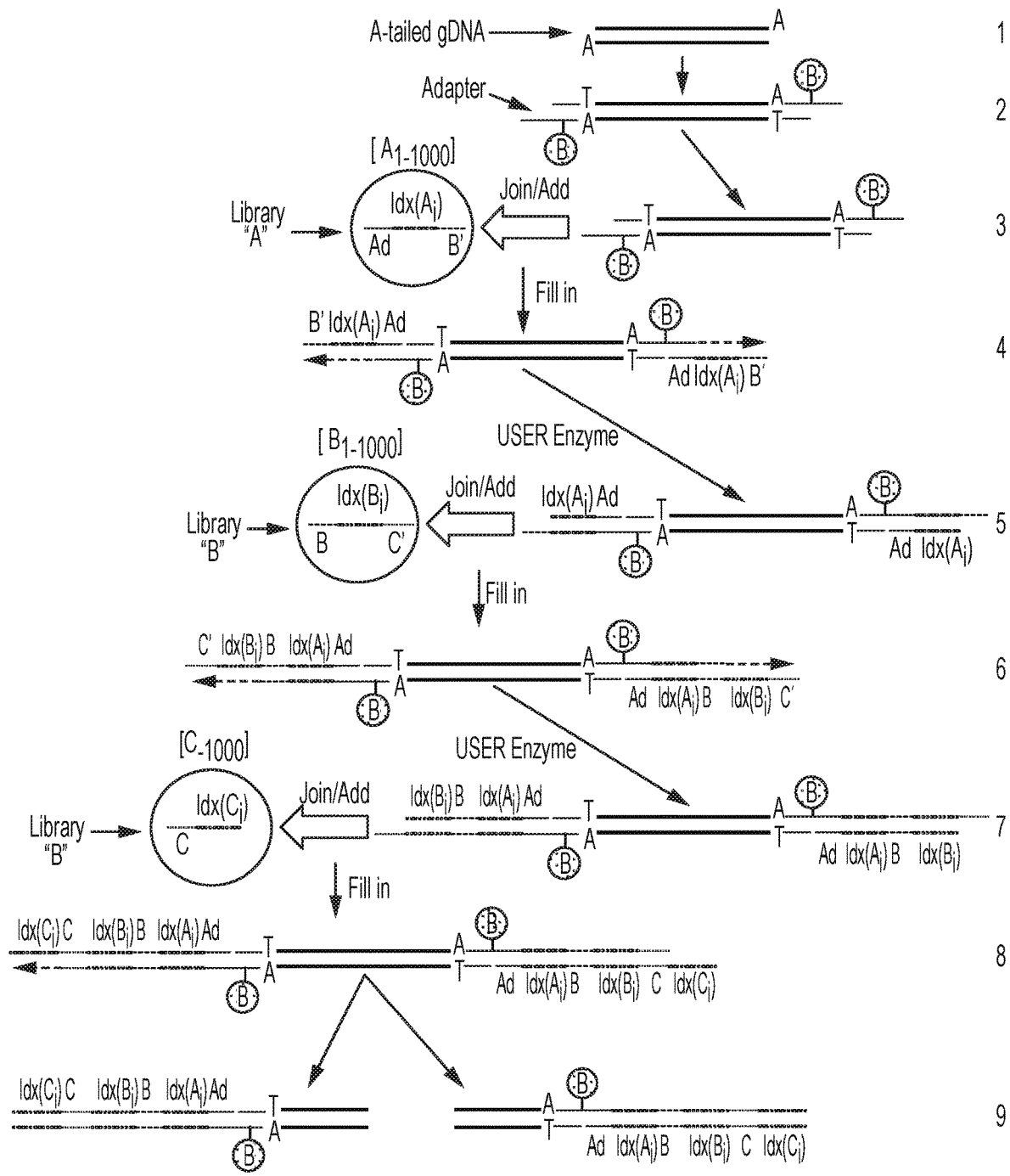
Figure 15A:
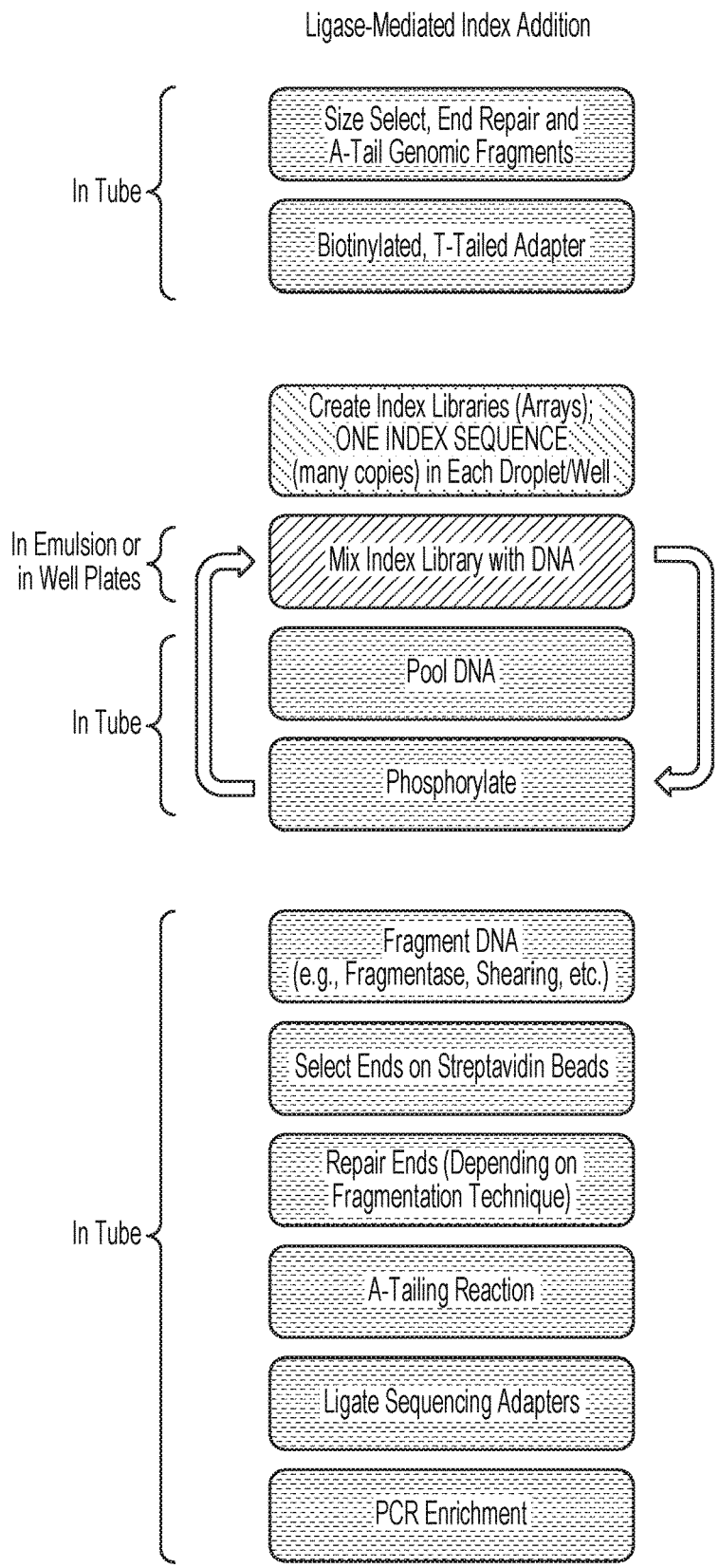
FIG. 15A-15B is a schematic depicting the technique for ligation mediated index addition.
Figure 15B:
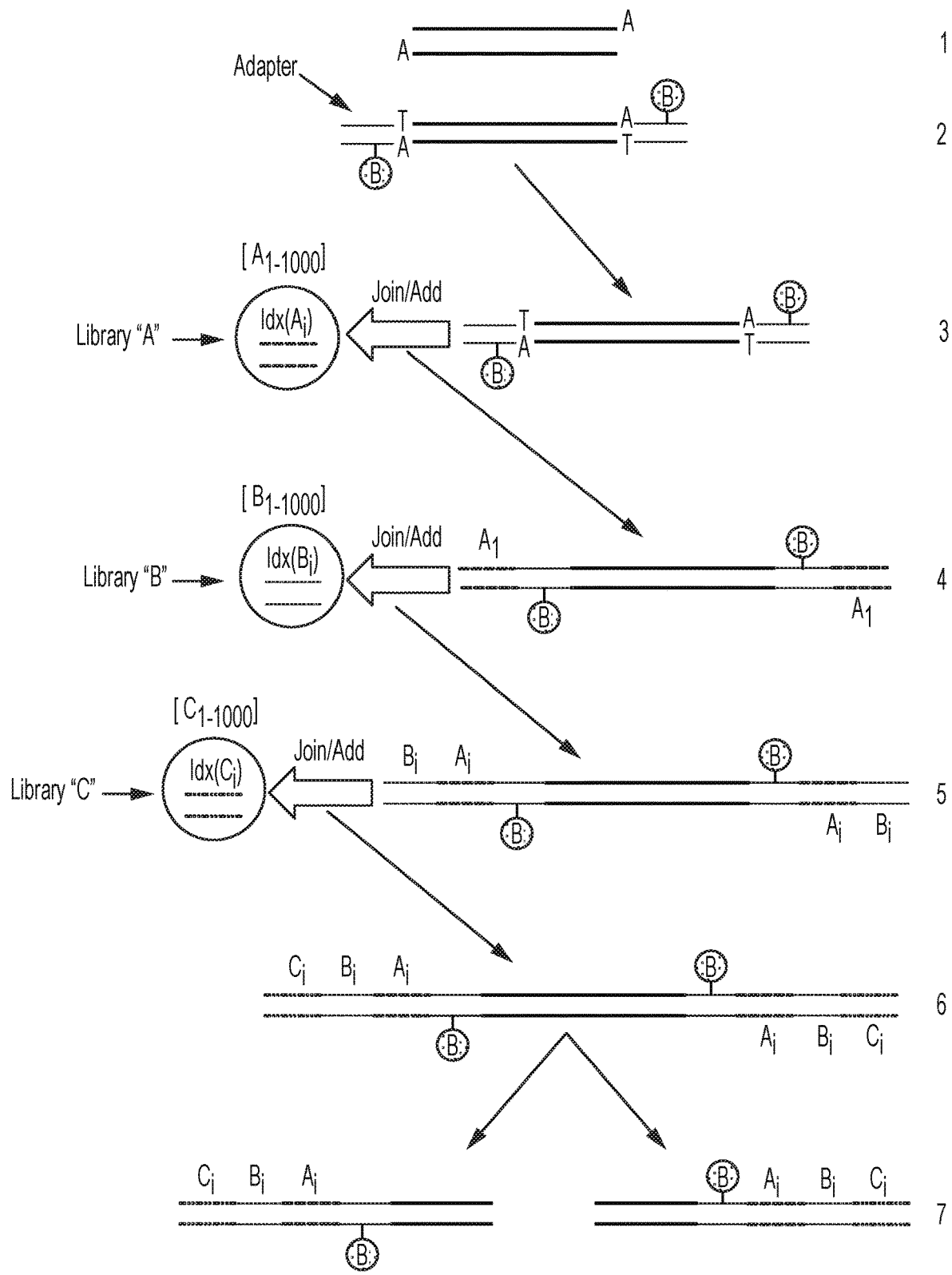
Figure 16:
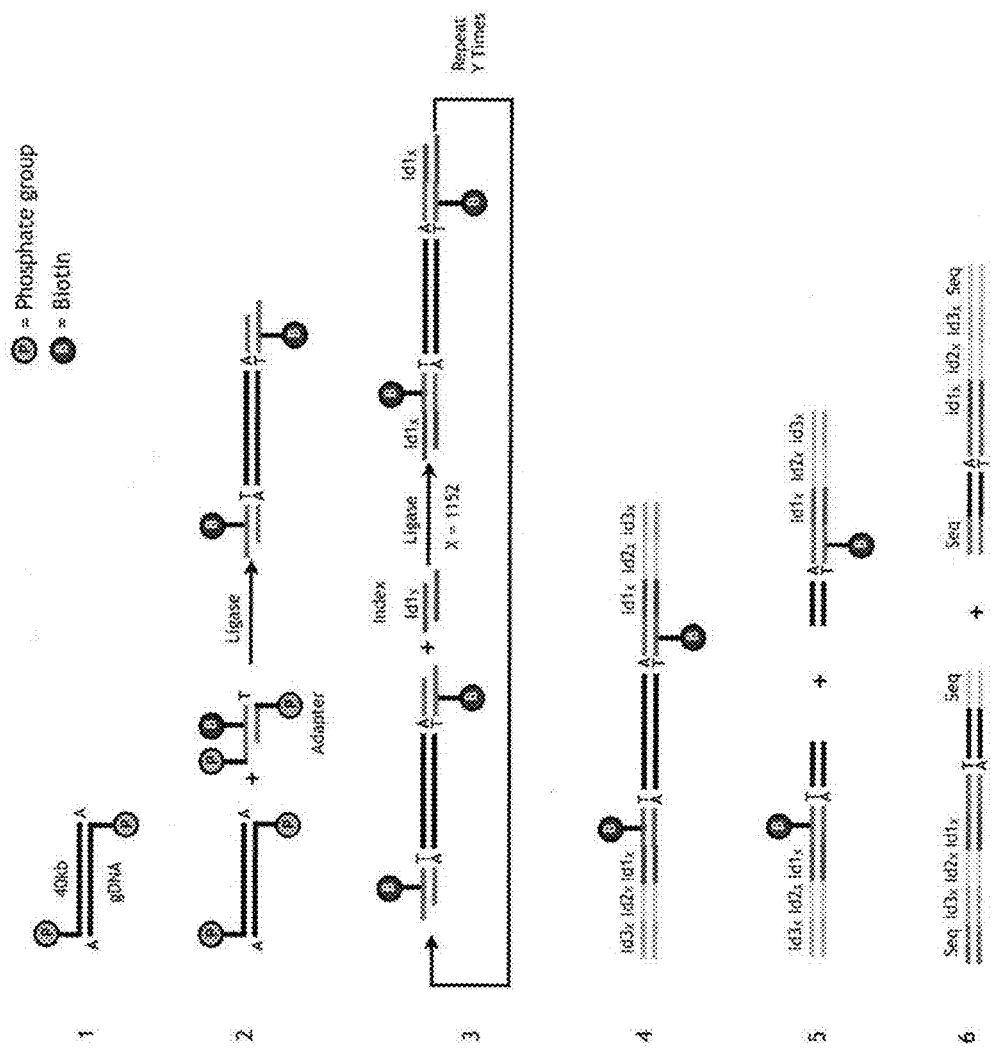
FIG. 16 is a schematic depicting the technique for symmetric ligation-mediated index addition.
Figure 17:
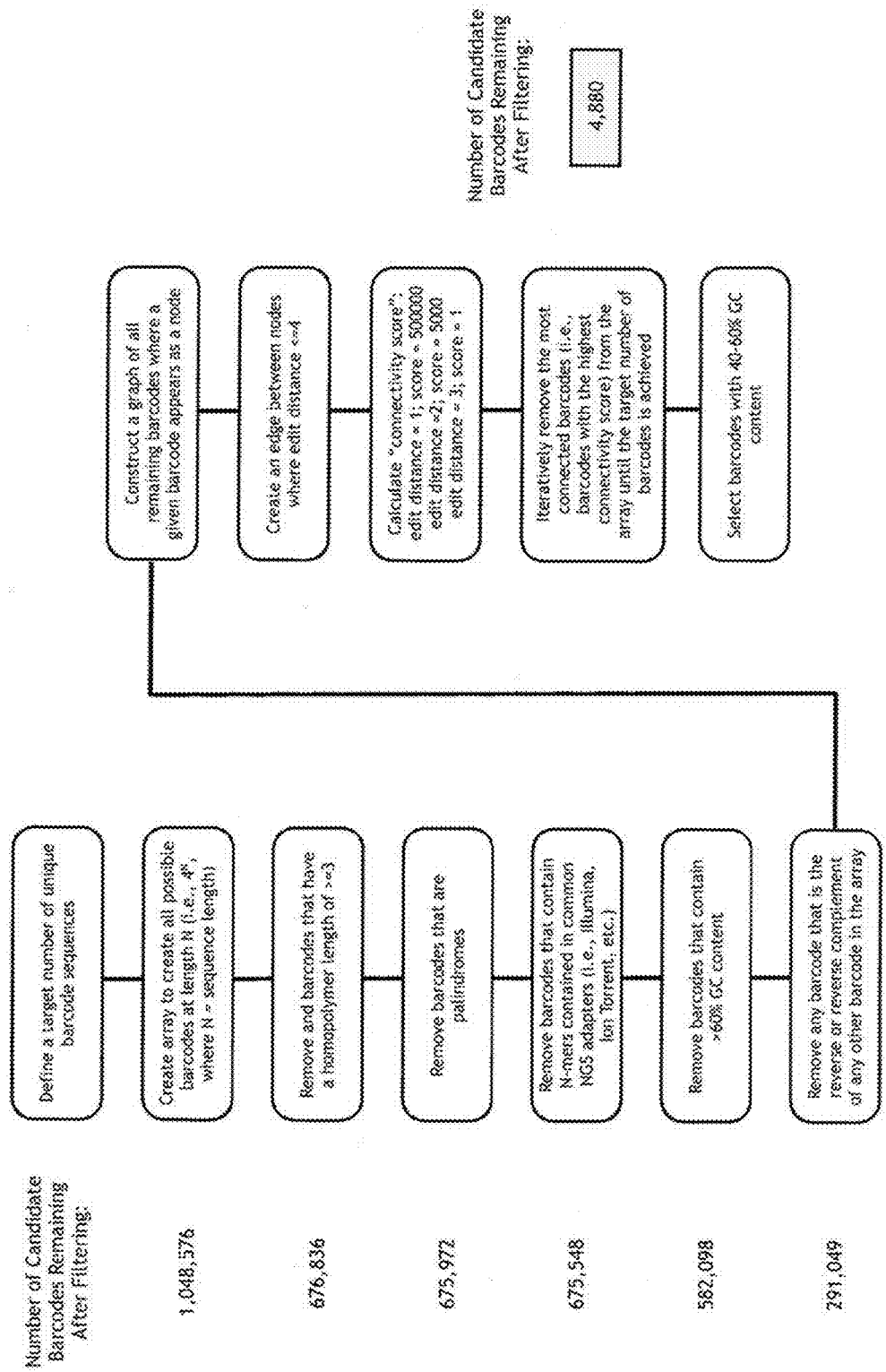
FIG. 17 is a flowchart detailing the criteria for barcode sequence selection.
Figure 19:
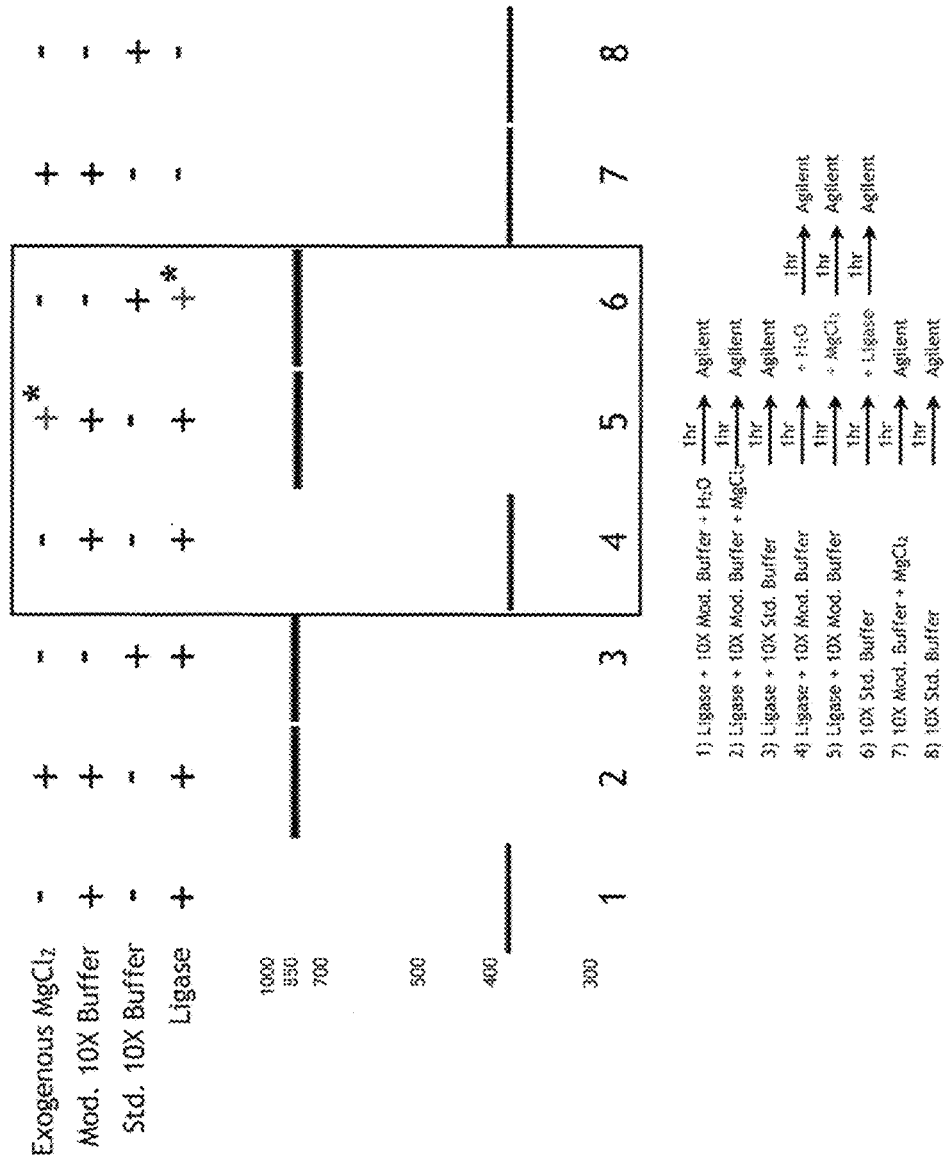
FIG. 19 shows catalyzing ligation by the controlled addition of $MgCl_2$.
Figure 20:
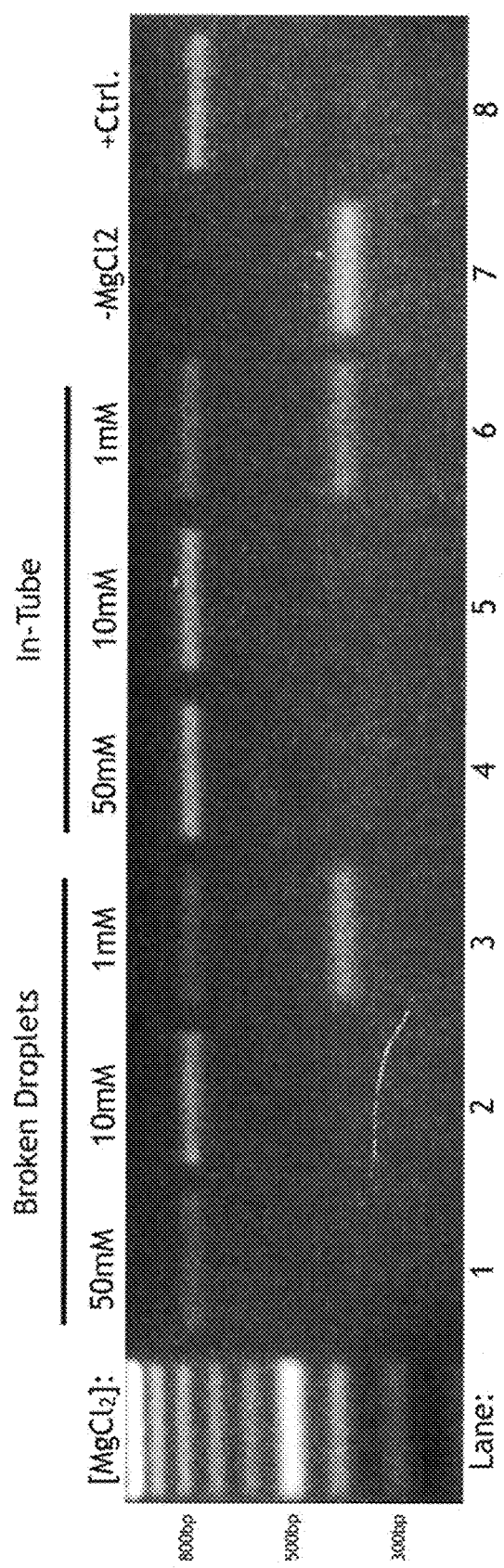
FIG. 20 shows a stability determination of $MgCl_2$ in droplets.
Figure 22A:
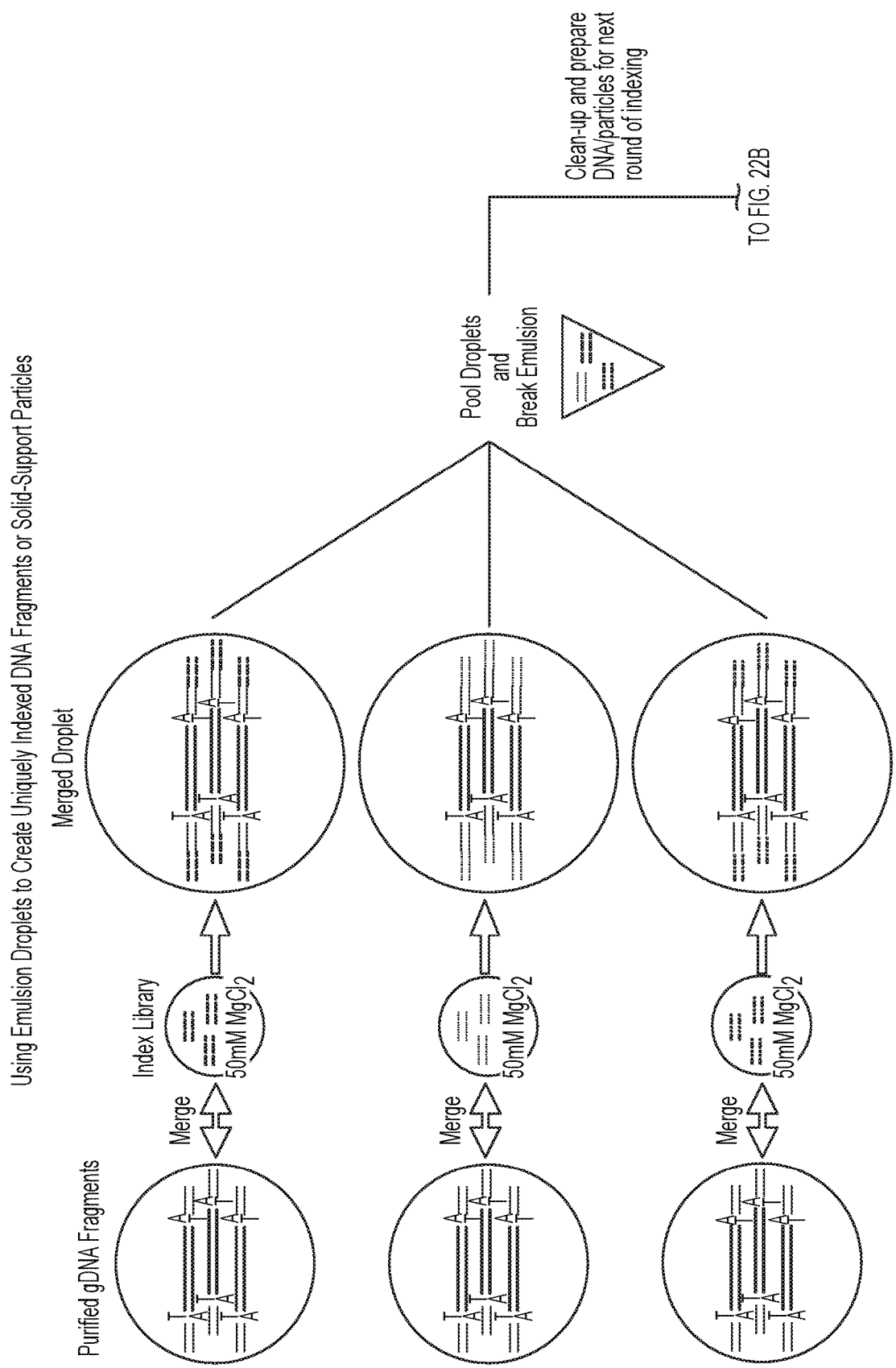
FIG. 22A-22B is a schematic depicting the process of symmetric indexing in emulsion.
Figure 22B:
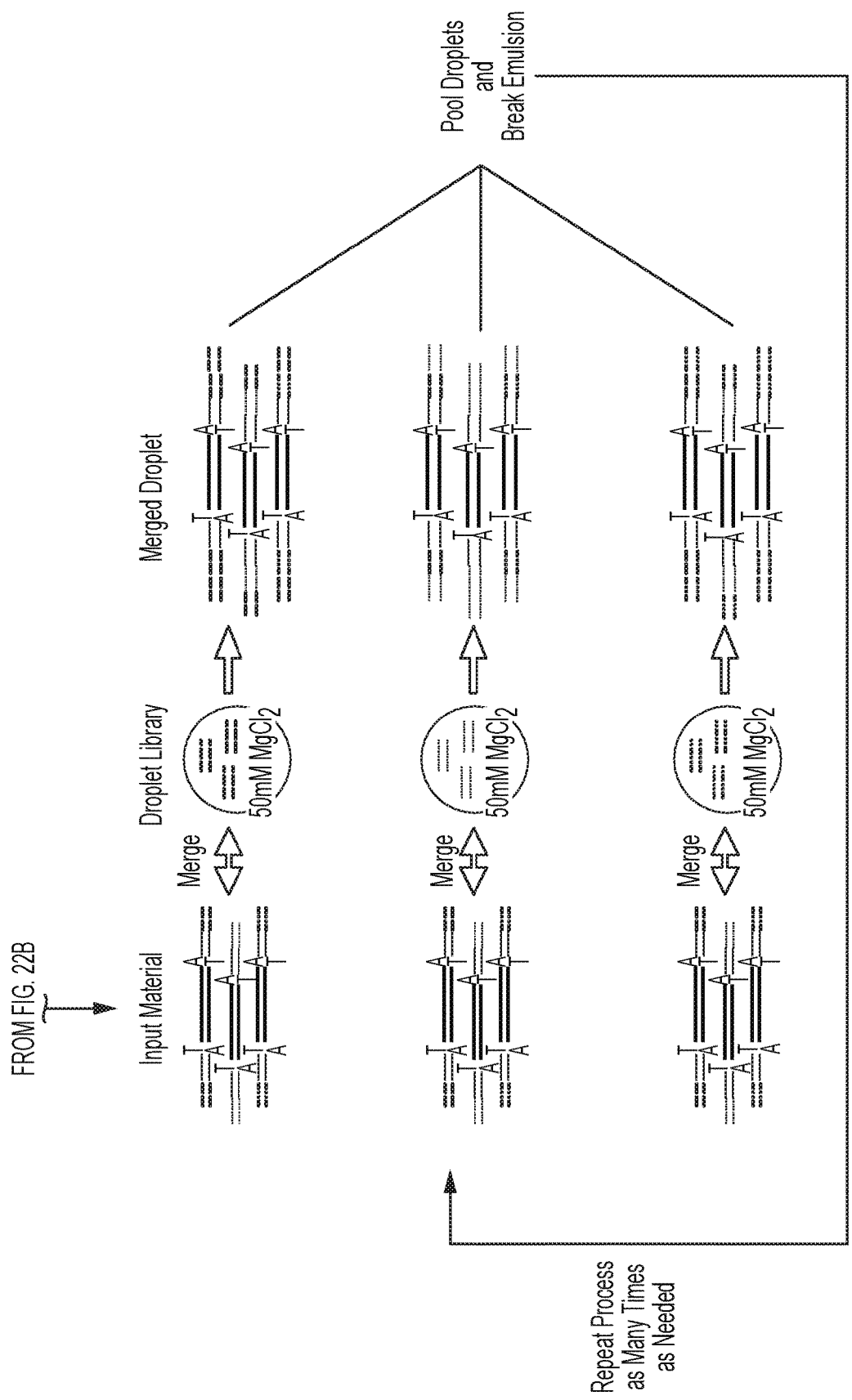
Figure 23:
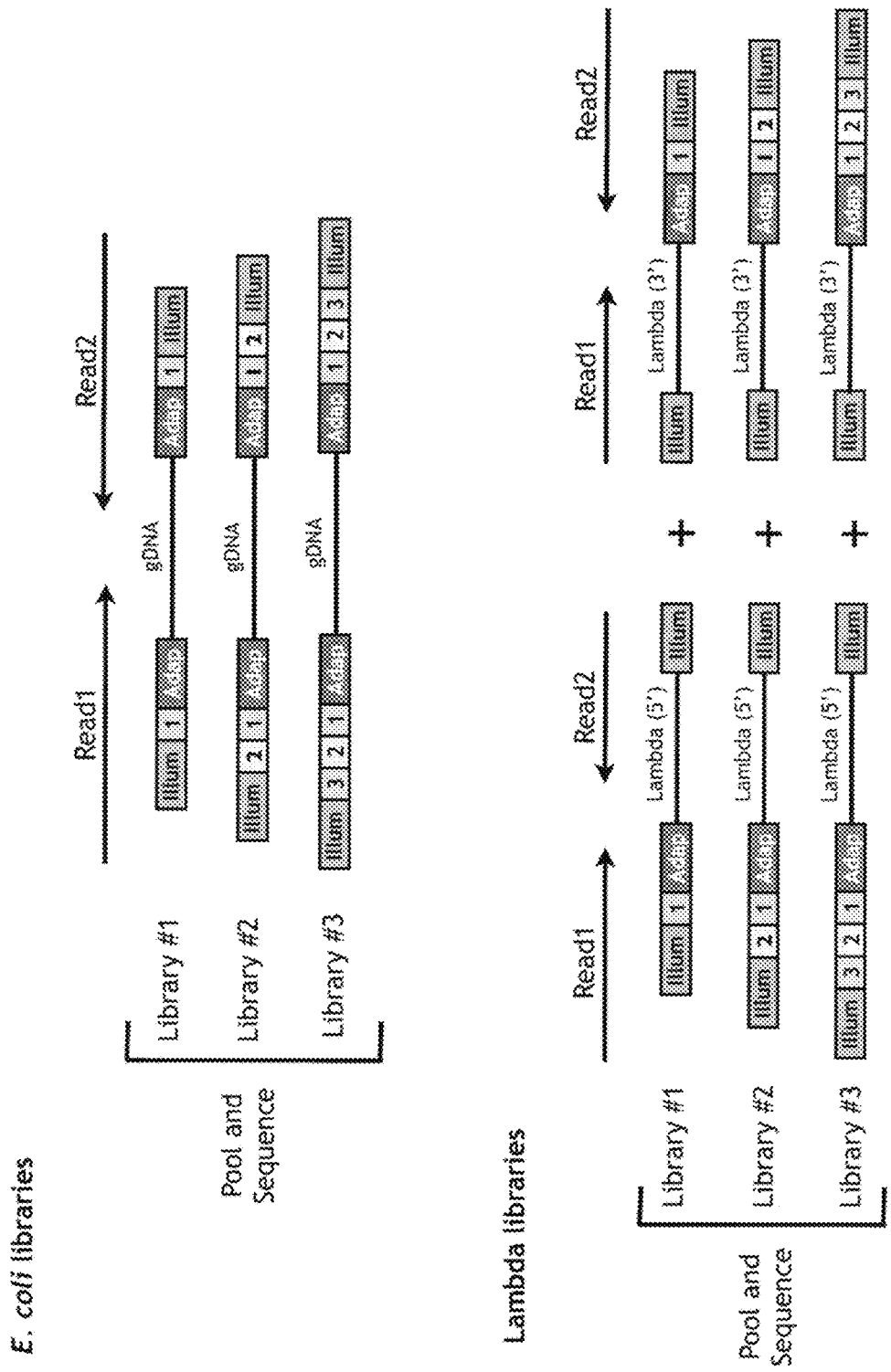
FIG. 23 shows a proof of concept experiment.
Figure 24:
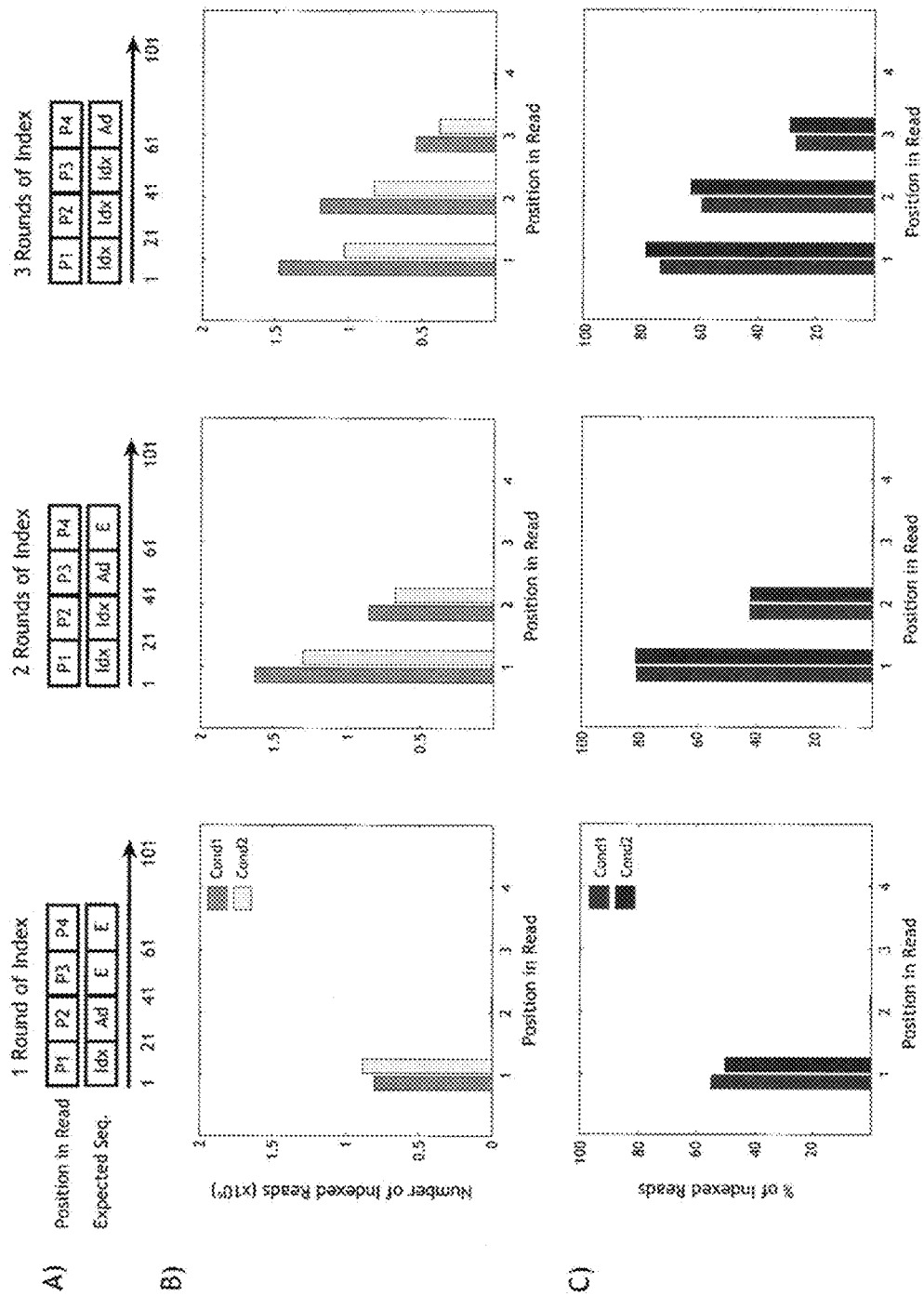
FIG. 24 shows an analysis of *E. coli* proof of concept libraries.
Figure 25:
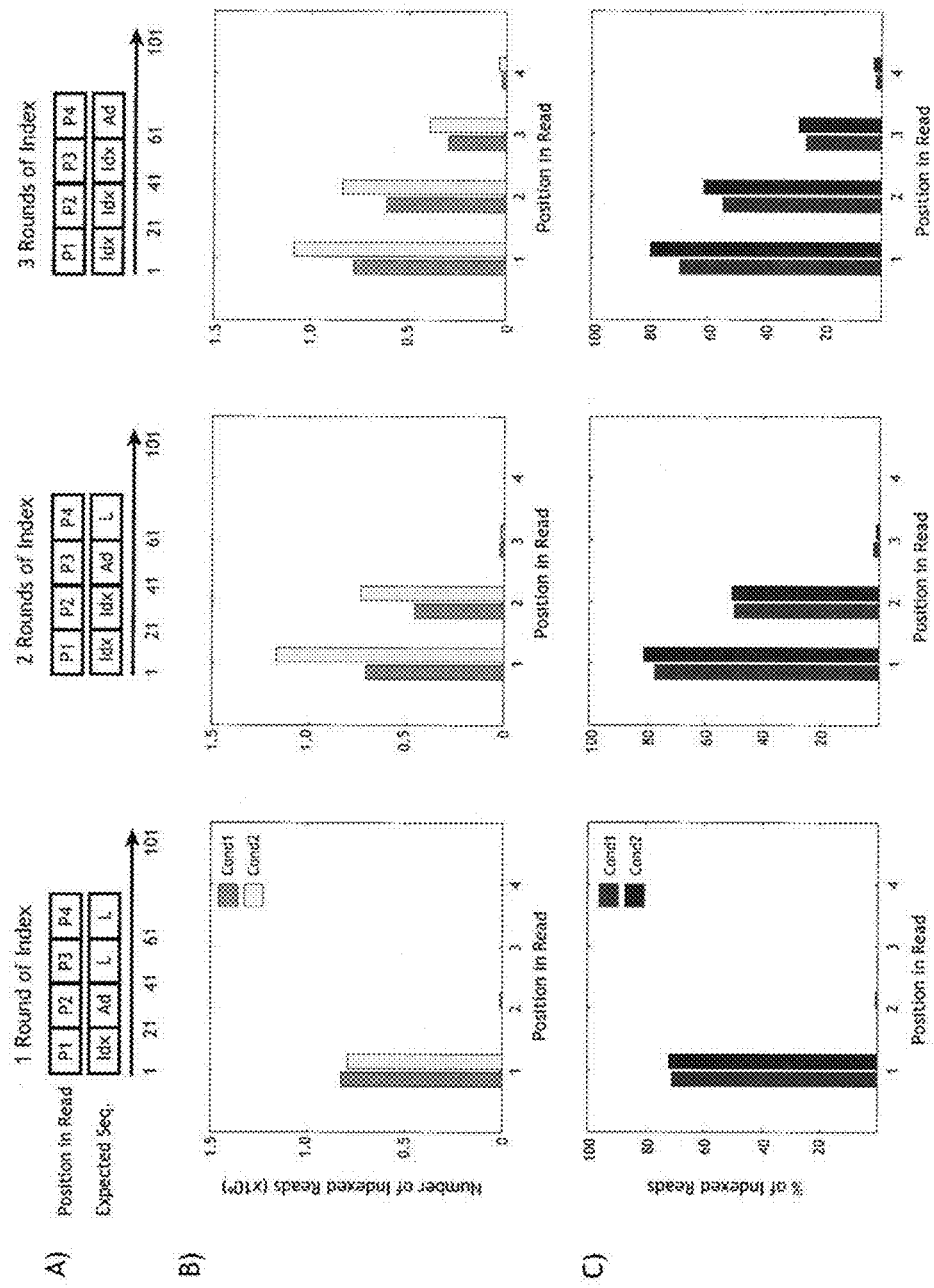
FIG. 25 shows an analysis of lambda proof of concept libraries.
Figure 26:
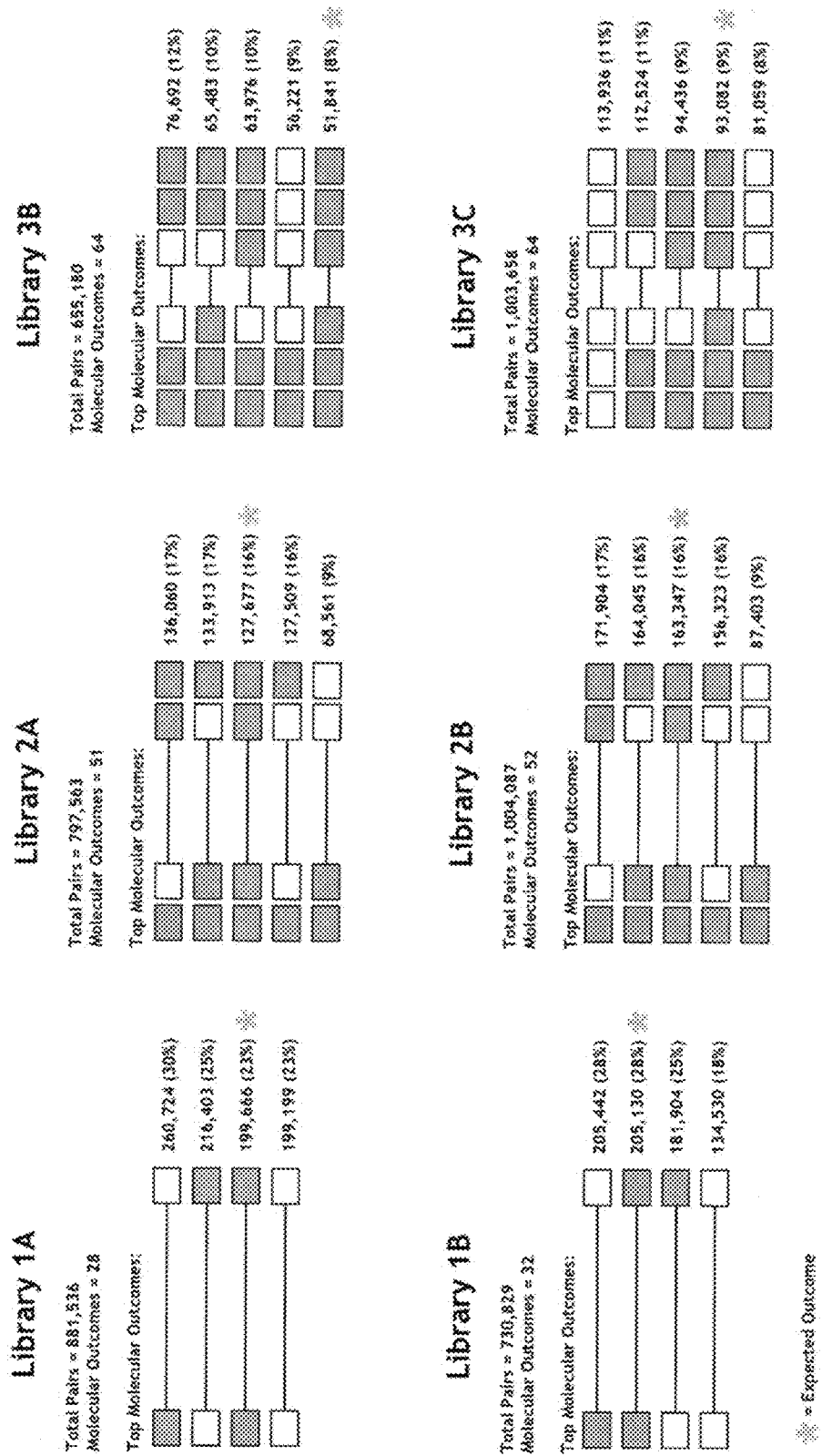
FIG. 26 shows a determination of symmetry of indexing in *E. coli* proof of concept libraries.
Figure 27:
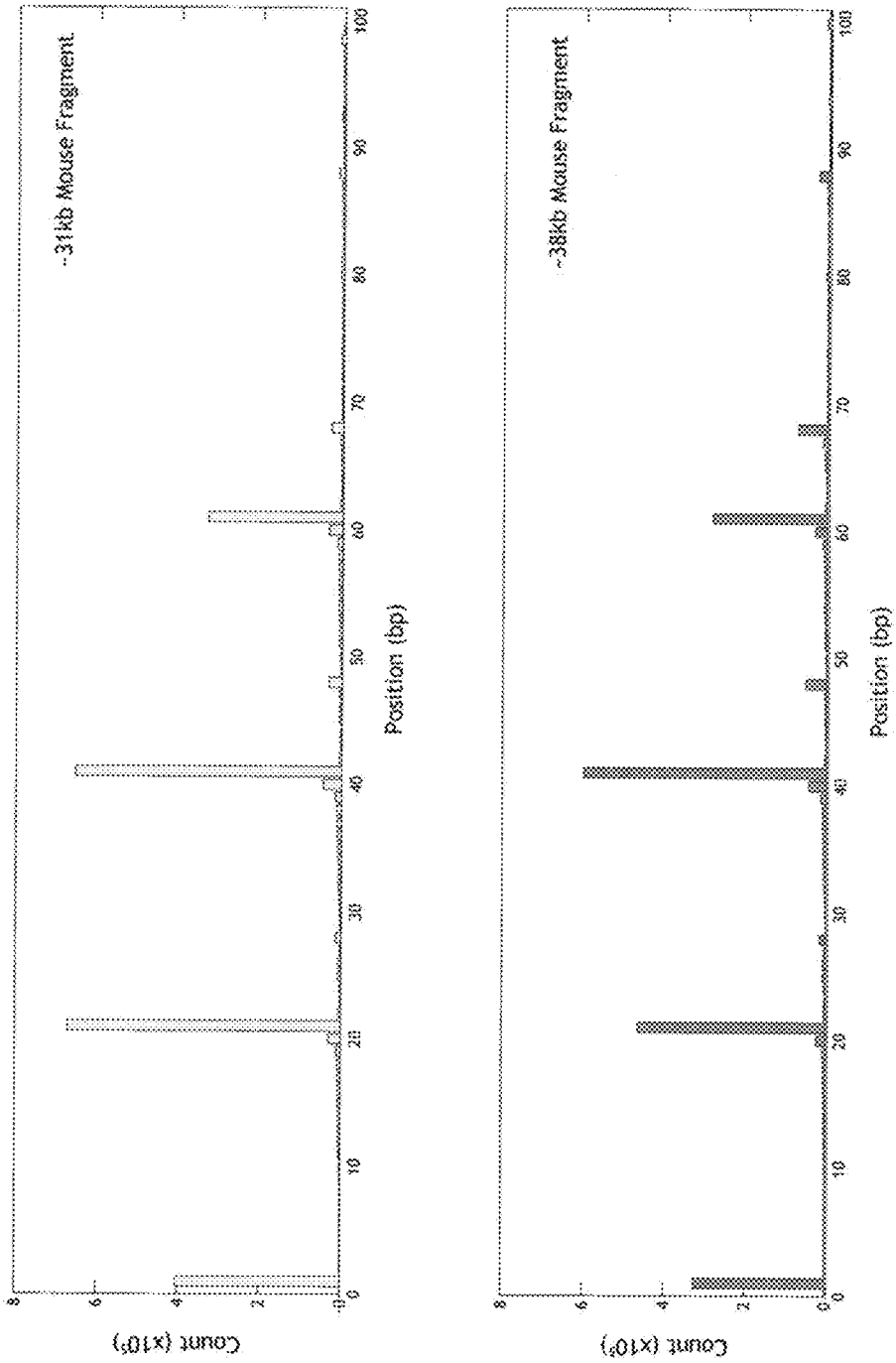
FIG. 27 shows the determination of uniformity of blunt-ended indexing.
Figure 29:
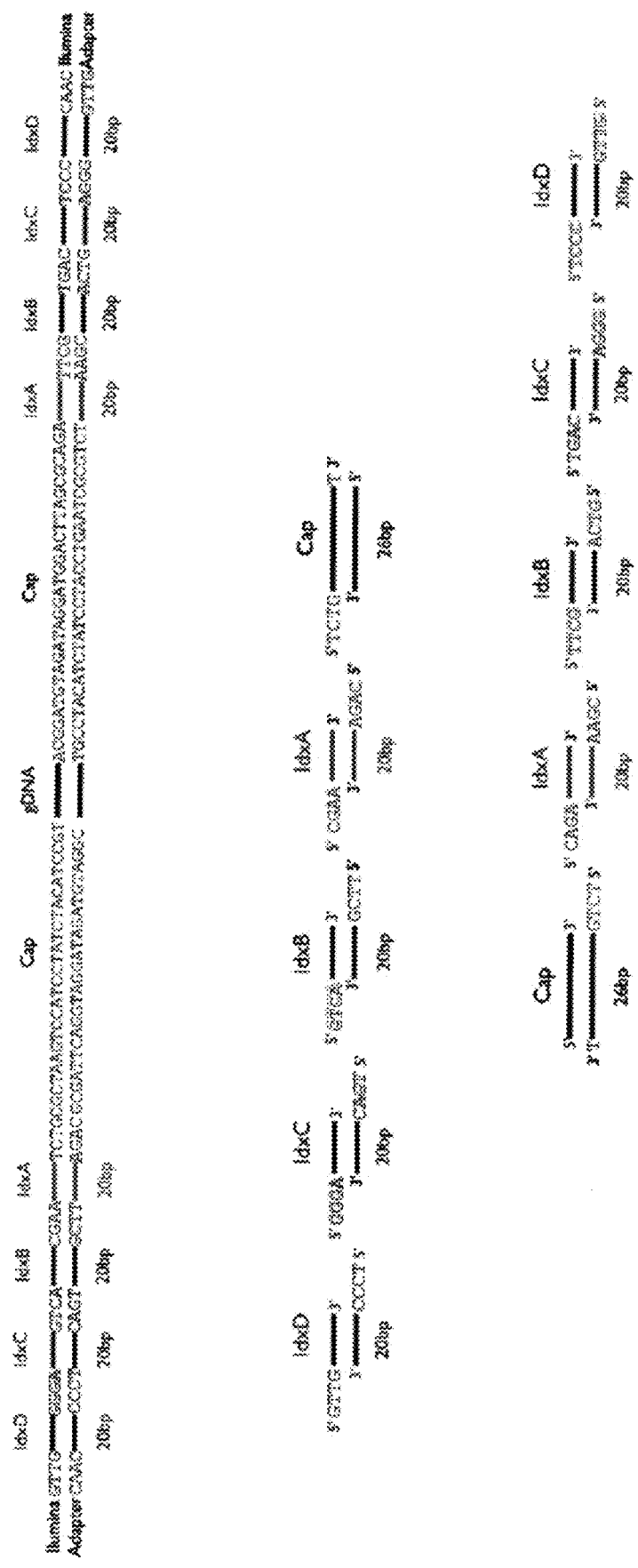
FIG. 29 shows a redesign of index sequences.
Figure 30:
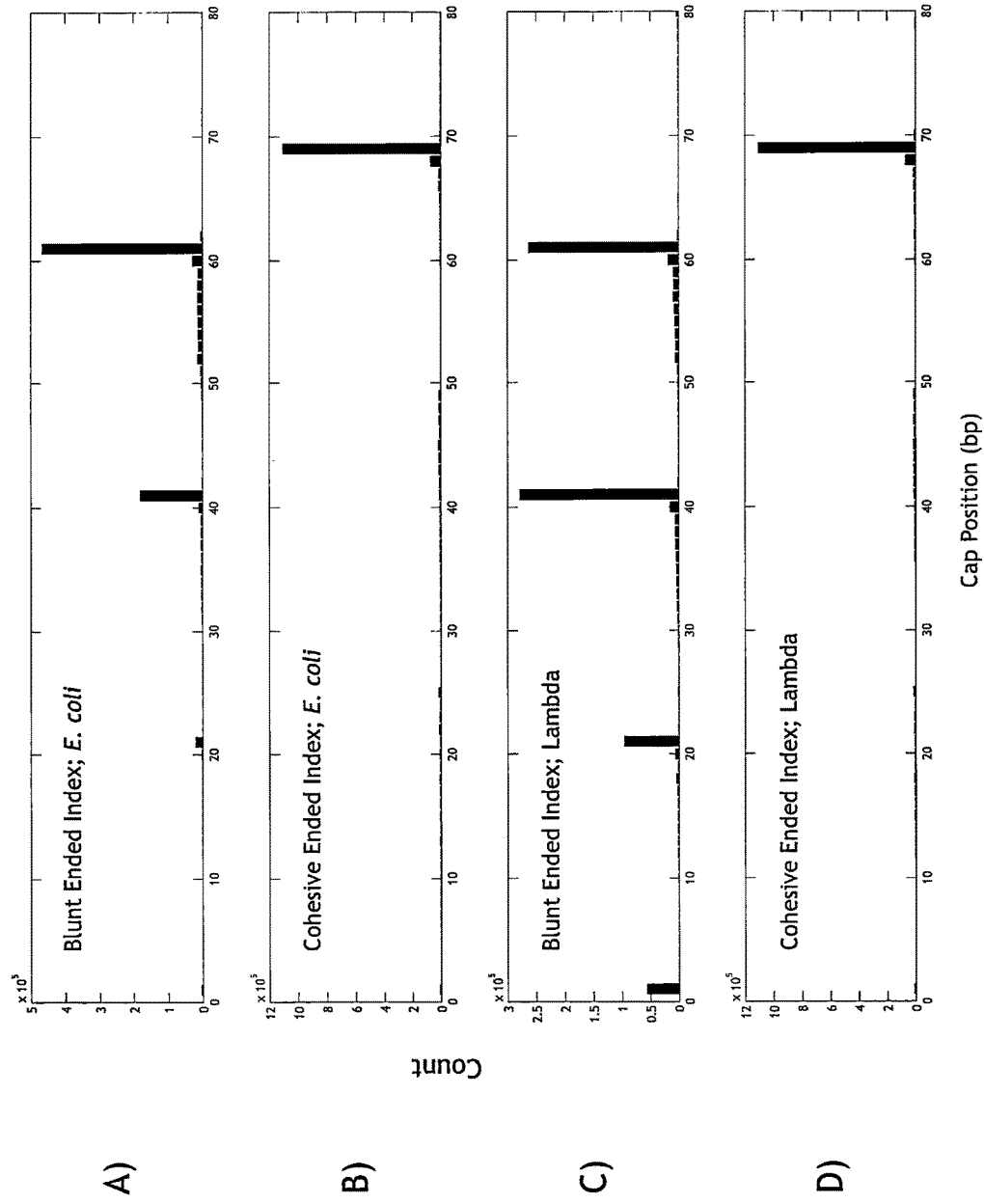
FIG. 30 shows uniformity of indexing.

As a proof of principle, streptavidin-coated magnetic particles (M280 Dynal beads, Invitrogen) were coated with two species of biotinylated oligos (A and B, see FIG. 12). A DNA library was created with the forked adapters and was amplified onto beads in an emulsion PCR containing solution phase primers and coated beads. Fluorescently labeled primers (Read Seq 1 and Read Seq 2) were annealed and beads were visualized to confirm the presence of both molecules on a single bead. Both molecules were shown to be present on a single bead.

Example 7

Blunt End Ligation

Initial attempts at preparing symmetrically indexed libraries utilized a single array of 20 bp blunt ended index sequences. To evaluate the technique, libraries were prepared from either Lambda genomic DNA (~48 kb) or E. coli genomic DNA sheared to approximately 500 bp. Lambda and E. coli samples were then subjected to three rounds of index ligation. Lambda samples were then sheared to an appropriate size using standard techniques (i.e., Covaris shearing). It was not necessary to shear the E. coli libraries after index ligation as they were already the correct size for Illumina sequencing. All samples were incubated with M-280 streptavidin beads to select molecules carrying the biotinylated cap adapter and were prepared as Illumina paired-end libraries according to standard techniques.

Analysis of these libraries revealed a mixed population of indexed reads where some contained only a single index, while other reads contained either two or three indexes. While this clearly indicated that not all molecules received the same number of indexes, it raised the possibility that molecules were not receiving the same number of molecules on both ends. Further analysis of the E. coli libraries determined that a large population of DNA fragments were asymmetrically indexed where one end harbored N number of indexes and the other end often carried N-1 (or N-2) indexes (data not shown). This raised a significant challenge at the analysis level since the mate-pairing algorithm was intended to pair reads based on their unique index combinations and the informative content of a given index "string" decreases as the number of indexes decreases. Although there are provisions in the algorithm to attempt pairing of less than perfectly matched ends, such pairings occur at a significantly lower confidence level.

Example 8

Cohesive Overhang Ligation

In an attempt to increase the symmetry of indexing from blunt end ligation (Example 3), all indexes were redesigned to contain a 4 bp (cohesive) overhang on each oligo. Specifically, three unique populations of indexes were created with each population containing a specific overhang on either end of the index. Thus, only members of the Index "A" population ligated only to the adapter (in a single orientation). Similarly, members of the Index "B" population ligated only to Index A, and members of Index "C" ligated only to Index B. To determine the effectiveness of this new strategy, Lambda and E. coli samples were prepared as before, but using the new cohesive ended indexes as described in more detail below.

Materials and Methods

Genomic DNA Preparation

E. coli genomic DNA was sheared to an average size of 400-600 bp in a Covaris microTube using a Covaris S2 instrument with the following settings: duty cycle=20%, intensity=cycles per burst=200, time=50 seconds. Lambda DNA (New England Biolabs, NEB) was not sheared prior to cap ligation and indexing to maintain an ~48 kb genomic DNA fragment.

Cap Ligation 5 ug of either sheared E. coli or Lambda DNA was end-repaired to create blunt ended fragments as follows: Samples were incubated in a reaction containing 1× Phosphorylation Buffer (NEB), 0.5 mM dNTP mix (NEB), 50U T4 Polynucleotide Kinase (NEB), 15U T4 DNA Polymerase (NEB) and 10U DNA Polymerase I Large Fragment (Klenow). Reactions were incubated at 20° C. for 30 minutes. Each sample was then purified by adding 1.8× volumes of AMPure XP beads as described in the manufacturer's recommended protocol (Beckman Coulter). Samples were then A-tailed at their 3' ends by incubating for 30 min. at 30° C. in 1× NEBuffer 2 (NEB), 0.2 mM dATP (NEB) and 25U Klenow Fragment (3'→4 5' exo-) (NEB). Samples were then purified by adding 1.8× volumes of AMPure XP beads as described above. Samples were then ligated to the Cap_v6_C adapter (duplexed DNA composed of: 5'—/5Phos/CGGATGTAGATAGGA/iBiodT/GGACTTAGCG—3' (SEQ ID NO: 2305) and 5'—/5Phos/TCTGCGCTAAGTCCATCCTATCTACATCCG*T—3' (SEQ ID NO: 2306) (*=phosphorothioate bond, /iBiodT/=biotinylated thymidine, /5Phos/=phosphorylated 5' base) (Integrated DNA Technologies, IDT) as follows. Samples were mixed with Cap_v6_C at a molar ratio of 1:100 (gDNA:Cap_v6_C) in a solution of customized ligation buffer containing 66 mM Tris-HCl, 10 mM MgCl2, 1 mM DTT, 1 mM ATP and 15% PEG 6000 (w/v) along with 10,000U T4 DNA ligase (NEB). Reactions were incubated at room temperature for 20 minutes and purified using 1.8× volumes of AMPure XP beads as described above.

Index Ligation

Cap_v6_C ligated DNA (Lambda or *E. coli*) was subjected to three rounds of index ligation. Three separate pools of index were prepared (round 1=pool "A", round 2=pool "B" and round 3=pool "C") with each pool containing four different index sequences (IDT, see attached for duplex sequences). For each round of index ligation, "template" DNA (i.e., Cap_v6_C ligated DNA) was mixed with the appropriate pool of index at a 1:100 molar ratio (template:index) and incubated for 20 minutes at room temperature in a reaction containing customized ligation buffer (see above) with 10,000U T4 DNA ligase (NEB). After each round of index ligation, samples were purified by adding 1.8× volumes of AMPure XP beads as described above.

Library Preparation

Following index ligation, Lambda samples were sheared to ~400-600 bp in length in a Covaris microTube using a Covaris S2 instrument with the following settings: duty cycle=20%, intensity=8, cycles per burst=200, time=50 seconds. *E. coli* samples were not sheared following index ligation. In order to select only the ends of the DNA fragments (i.e., fragments carrying biotinylated. Cap_v6_C), samples were then mixed with 50 uL of M-280 streptavidin beads that had been prepared according to the manufacturer's recommended protocol (Life Technologies). Samples were then end repaired and A-tailed in the reaction mixes described above and ligated to standard Illumina indexed adapters (alumina) in a reaction containing 1× NEB Quick Ligation Reaction Buffer and 10,000U of Quick T4 DNA Ligase (NEB). After each of the enzymatic reactions (i.e., end repair, A-tailing and lumina adapter ligation), beads were washed three times in 1× library wash buffer (5 mM Tris-HCl pH 7.5, 0.5 mM EDTA, 0.5 M NaCl, 0.1% Tween-20). Following adapter ligation, tubes were placed on a magnet for 1 minute and the supernatant was discarded. Beads were then resuspended in a reaction containing 1× Phusion PCR Master Mix (NEB) and lumina PCR Primers (PE 1.0/2.0). Library amplification was performed using the following conditions: 98° C. for 30 sec., 18 cycles of {98° C. for 10 sec.; 65° C. for 30 sec.; 72° C. for 30 sec.}, 72° C. for 5 min. Tubes were then placed on a magnet for 1 minute and the supernatant transferred to a new tube. Samples were the purified by adding 0.75× volumes of AMPure XP beads as described above. The concentration and size distribution of each library was confirmed on an Agilent Bioanalyzer using a DNA 7500 Kit according to the manufacturer's recommended protocol (Agilent Technologies).

Sequencing

Illumina sequencing libraries were quantified using quantitative PCR (KAPA Biosystems). Based on qPCR quantification, libraries were normalized to 2 nM and then denatured using 0.1 N NaOH using Perkin-Elmer's MiniJanus liquid handling platform. Cluster amplification of denatured templates was performed according to the manufacturer's protocol (Illumina) using HiSeq v3 cluster chemistry and flowcells. Flowcells were sequenced, using 101-bp paired end reads, on HiSeq 2000 using HiSeq v3 Sequencing-by-Synthesis Kits, then analyzed using the latest version of RTA.

Data Analysis

Unaligned sequence data was analyzed using a series of AWK commands designed to identify sequences that are a perfect match for a 20 bp region of the Cap_v6_C sequence (TCTGCGCTAAGTCCATCCTA (SEQ ID NO: 2307)). The position of the Cap_v6_C sequence in a given read was recorded and tallied to determine the total number of reads containing Cap_v6_C sequence at a given position.

Index Sequences

| Pool | Duplex Name | Oligo Name | SEQ ID NO: | Sequence (5' → 3') |
|---|---|---|---|---|
| A | IDX_A5_C | IDX_A5_Top | 769 | /5Phos/CAGAGGATATCTGTGGATATCTGT |
| A | | IDX_A5_Bot | 1537 | /5Phos/CGAAACAGATATCCACAGATATCC |
| A | IDX_A6_C | IDX_A6_Top | 770 | /5Phos/CAGAGGCTGCCATAGGCTGCCATA |
| A | | IDX_A6_Bot | 1538 | /5Phos/CGAATATGGCAGCCTATGGCAGCC |
| A | IDX_A7_C | IDX_A7_Top | 771 | /5Phos/CAGAGGTATGTCAAGGTATGTCAA |
| A | | IDX_A7_Bot | 1539 | /5Phos/CGAATTGACATACCTTGACATACC |
| A | IDX_A8_C | IDX_A8_Top | 772 | /5Phos/CAGAGGTGAAGGACGGTGAAGGAC |
| A | | IDX_A8_Bot | 1540 | /5Phos/CGAAGTCCTTCACCGTCCTTCACC |
| B | IDX_B5_C | IDX_B5_Top | 2309 | /5Phos/TTCGGTACCAGCATGTACCAGCAT |
| B | | IDX_B5_Bot | 2309 | /5Phos/GTCAATGCTGGTACATGCTGGTAC |
| B | IDX_B6_C | IDX_B6_Top | 2310 | /5Phos/TTCGGTATACATCCGTATACATCC |
| B | | IDX_B6_Bot | 2311 | /5Phos/GTCAGGATGTATACGGATGTATAC |
| B | IDX_B7_C | IDX_B7_Top | 2312 | /5Phos/TTCGGTATCGCTCAGTATCGCTCA |
| B | | IDX_B7_Bot | 2313 | /5Phos/GTCATGAGCGATACTGAGCGATAC |
| B | IDX_B8_C | IDX_B8_Top | 2314 | /5Phos/TTCGGTCCGATGGAGTCCGATGGA |
| B | | IDX_B8_Bot | 2315 | /5Phos/GTCATCCATCGGACTCCATCGGAC |
| C | IDX_C5_C | IDX_C5_Top | 2316 | /5Phos/TGACGTGTGGAATTGTGTGGAATT |
| C | | IDX_C5_Bot | 2317 | AATTCCACACAATTCCACAC |
| C | IDX_C6_C | IDX_C6_Top | 2318 | /5Phos/TGACGTGTGGCAGAGTGTGGCAGA |
| C | | IDX_C6_Bot | 2319 | TCTGCCACACTCTGCCACAC |
| C | IDX_C7_C | IDX_C7_Top | 2320 | /5Phos/TGACGTTACGGTGAGTTACGGTGA |
| C | | IDX_C7_Bot | 2321 | TCACCGTAACTCACCGTAAC |
| C | IDX_C8_C | IDX_C8_Top | 2322 | /5Phos/TGACGTTCGTACATGTTCGTACAT |
| C | | IDX_C8_Bot | 2323 | ATGTACGAACATGTACGAAC |

Upon analysis of the sequencing data, a clear improvement in the consistency of indexing was observed; instead of observing a highly mixed population of reads with 1, 2, or 3 indexes, the predominant population of reads contained 3 indexes.

Example 9

Kits

A kit is made which may comprise indexed labels, such as beads, on a probe that hybridizes with a region of gene as described herein and can be used to detect a pathogen. The kit includes one or more other elements including: instructions for use; and other reagents, e.g., a label, or an agent useful for attaching a label to the probe. Instructions for use includes instructions for diagnostic applications of the probe for predicting response to treatment in a method described herein. Other instructions can include instructions for attaching a label to the probe, instructions for performing analysis with the probe, and/or instructions for obtaining a sample to be analyzed from a subject. The kit can include a label, e.g., a fluorophore, biotin, digoxygenin, and radioactive isotopes such as 32P and 3H.

Example 10

Fragment Amplification

Transposome-based Selection and Amplification of Ends

As shown in FIG. 36, DNA samples are sheared to a desired size then the "Cap" and random combinations of index sequences are symmetrically attached to the fragment ends via ligation. Following the final round of index ligation, a new adapter containing an Illumina sequencing primer (SP1) adjacent to the Illumina P7 sequence is attached to the ends of the molecules via ligation as described above. The population of molecules is then incubated in the presence of a transposome carrying a different Illumina sequencing primer (SP2) adjacent to the Illumina P5 sequence. This reaction creates many fragments where both ends are flanked by the Illumina P5 sequence, but only two fragments per molecule that carry both the Illumina P7 and P5 sequences. PCR amplification using primers to P5/P7 is performed in order to enrich/select the fragment ends.
Enrichment of Ends Via In Vitro Transcription As seen in FIGS. 37a and 37b, DNA samples are sheared to a desired size then the Cap and random combinations of index sequences are symmetrically attached to the fragment ends via ligation. Following the final round of index ligation, a new adapter sequence containing an Illumina sequencing primer (SPI) adjacent to an optimized T7 RNA polymerase promoter is attached to the ends of the molecules via ligation as described above. In vitro transcription (IVT) via T7 RNA polymerase is then performed in order to amplify both ends of a given molecule. Following IVT, a primer containing a random nucleotide sequence of a set length (i.e., pentamer, hexamer, etc.) flanked by a different Illumina sequencing primer (SP2) is utilized as the primer in a reverse transcription reaction. Alternatively, RNA molecules may be trimmed to a desired size range and ligated to the Illumina sequencing primer (SP2) via standard techniques. Illumina. P5 and P7 sites are then added to the cDNA via PCR using primers carrying Illumina P5-SP1 and P7-SP2 sequences.
Amplification of Ends via Anchored PCR As shown in FIG. 38, DNA samples are sheared to a desired size then the Cap and random combinations of index sequences are symmetrically attached to the fragment ends via ligation. Following the final round of index ligation, a new adapter containing an Illumina sequencing primer (SP1) adjacent to the Illumina P7 sequence is attached to the ends of the molecules via ligation as described above. The population of molecules is then incubated in the presence of Fragmentase or a cocktail of restriction endonucleases to liberate the ends of the molecules. Fragments are then tailed at the 3' end using terminal transferase to attach a set number of specific nucleotides to the fragment ends, effectively creating a common priming sequence on the ends of all molecules. Alternatively, priming sequences may he ligated to the 3' of the molecules using standard techniques. The fragments are then amplified via PCR using SP2-P7 and SPT-P5 primers where the SN-P5 primer contains a tail complementary to the priming site attached in the previous step.

Example 11

Creating Multi-Kilobase Fragment Reads from Indexed DNA Ends

Figure 39:
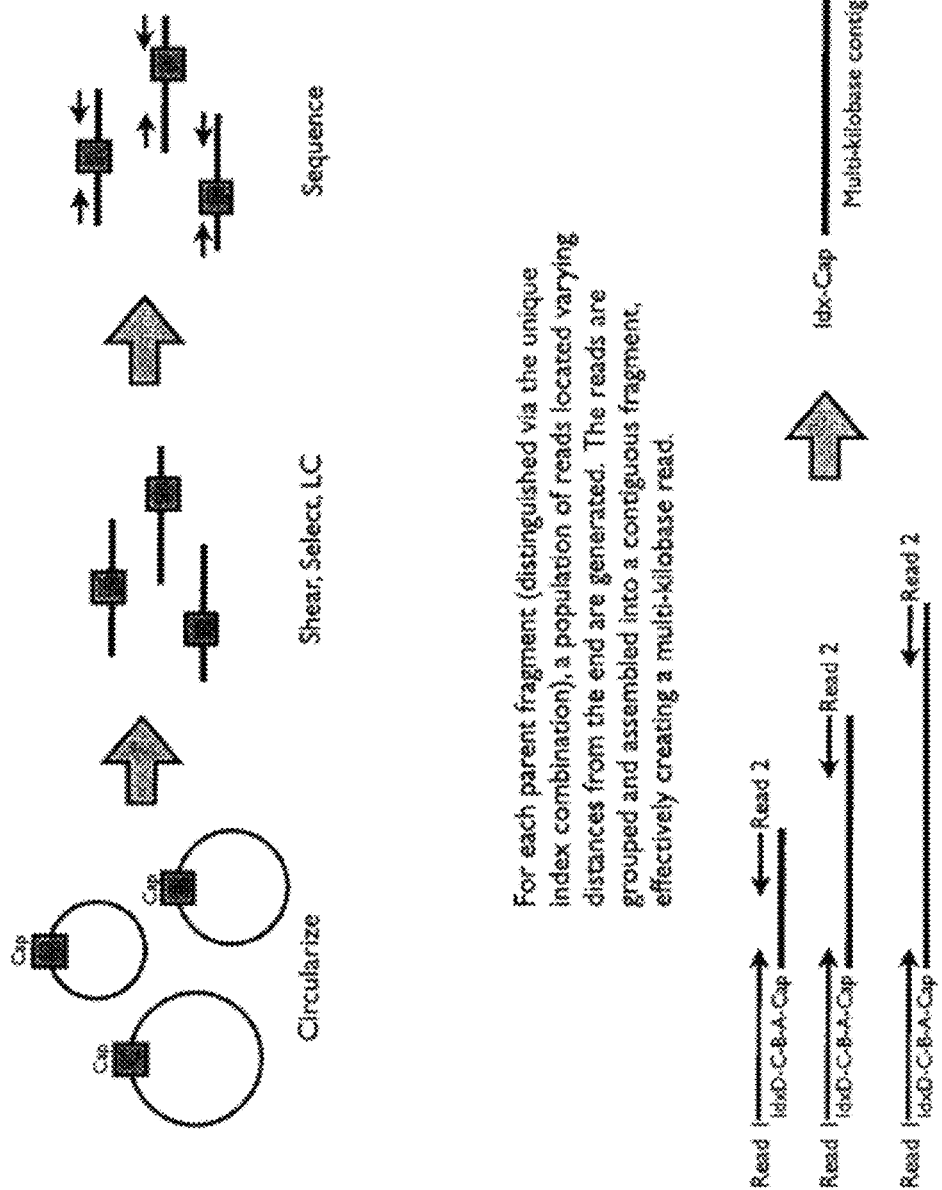
FIG. 39 shows producing multi-kilobase fragment reads from indexed DNA ends.
Figure 39:
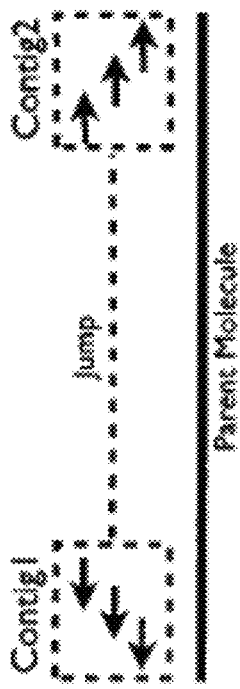

The indexed jump method of the invention also enables multi-kilobase reads/jumps on the Illumina platform that allows for the assembly and analysis of extremely challenging genomes. As described in FIG. 39, DNA samples are sheared to a desired size then the Cap and random combinations of index sequences are symmetrically attached to the fragment ends via ligation. Following the final round of index ligation, a new adapter sequence containing an Illumina sequencing primer (SP1) adjacent to an optimized T7 RNA polymerase promoter is attached to the ends of the molecules via ligation as described above. In vitro transcription (IVT) via T7 RNA polymerase is then performed in order to amplify both ends of a given molecule. Next, cDNA is prepared via random (or directed) priming and molecules are circularized and prepared for Illumina sequencing using standard jumping library construction methods. For each parent fragment (distinguished via the unique index combination), a population of reads located varying distances from the end are generated. The reads are grouped and assembled into a contiguous fragment, effectively creating a multi-kilobase read. Additionally, multi-kilobase contigs can be paired via their unique index combination to define a jump that is equal to the distance of the starting (parent) DNA fragment. This is a powerful combination of sequence and physical coverage that can enable the assembly of extremely challenging genomes (e.g., plant genomes).

The invention will be further described by the following numbered paragraphs:

1. A method for labeling an agent with a unique label, comprising the steps of:
   a) providing a pool of agents; and
   b) sequentially end-labeling said agents with a random combination of n detectable oligonucleotide tags, each of said oligonucleotide tags optionally comprising a cohesive overhang of x base pairs in length,
      wherein each detectable oligonucleotide tag is randomly and independently selected from a number of detectable oligonucleotide tags that is less than the number of agents, and n is the number of oligonucleotides attached to an end of said agent.

2. The method according to paragraph 1, wherein said agent is a nucleic acid, a solid support or a protein.

3. The method according to paragraph 1, wherein the agent is a nucleic acid.

4. The method according to paragraph 1, wherein x is greater than about two base pairs.

5. The method according to paragraph 1, wherein x is from about two to about ten base pairs.

6. The method according to paragraph 1, wherein x is about four base pairs.

7. The method according to paragraph 1, wherein said detectable oligonucleotide tag is from about 10 to about 20 base pairs in length.

8. The method according to paragraph 5, wherein said oligonucleotide tag is selected from a tag in Table 1.

9. The method according to paragraph 1, wherein n is 2, 3, 4, 5, 6, 7, 8, 9, 10, $10^2$, $10^3$, $10^4$, $10^5$, or $10^6$ or more detectable oligonucleotide tags.

10. The method according to paragraph 1, wherein said method is performed in a multi-well plate.

11. The method according to paragraph 1, wherein said method is performed with a robotic liquid-handler.

12. A library of uniquely labeled nucleic acids, comprising sequentially end-labeled nucleic acids with a random combination of n detectable oligonucleotide tags, each of said oligonucleotide tags comprising an cohesive overhang of x base pairs in length, wherein each detectable oligonucleotide tag is randomly and independently selected from a number of detectable oligonucleotide tags that is less than the number of nucleic acids, and n is the number of oligonucleotides attached to an end of said nucleic acid.

13. The library according to paragraph 12, wherein x is greater than about two base pairs.

14. The library according to paragraph 12, wherein x is from about two to about ten base pairs.

15. The library according to paragraph 12, wherein x is about four base pairs.

16. The library according to paragraph 12, wherein n is 2, 3, 4, 5, 6, 7, 8, 9, 10, $10^2$, $10^3$, $10^4$, $10^5$, or $10^6$ or more detectable oligonucleotide tags.

17. A method comprising
sequentially end-labeling nucleic acids in a plurality, at their 5' and 3' ends, with a random combination of n detectable oligonucleotide tags,
wherein each end-labeled nucleic acid is
(a) identically labeled at its 5' and 3' ends, and
(b) uniquely labeled relative to other nucleic acids in the plurality,
wherein each detectable oligonucleotide tags is randomly and independently selected from a number of detectable oligonucleotide tags that is less than the number of nucleic acids, and n is the number of oligonucleotides attached to an end of a nucleic acid.

18. The method of paragraph 17, wherein the number of oligonucleotides is 10-fold, 100-fold, 1000-fold, or 10000-fold less than the number of nucleic acids.

19. The method of paragraph 17, further comprising fragmenting end-labeled nucleic acids into at least a 5' fragment comprising the 5' end of the nucleic acid attached to the random combination of n oligonucleotide tags and into a 3' fragment comprising the 3' end of the nucleic acid attached to the random combination of n oligonucleotide tags.

20. The method of paragraph 19, wherein the 5' and 3' fragments are about 10-1000 bases (base pairs) in length, or about 10-500 bases in length, or about 10-200 bases in length.

21. The method of paragraph 17, further comprising sequencing the 5' and 3' fragments.

22. The method according to paragraph 17, wherein said method is performed in a multi-well plate.

23. The method according to paragraph 17, wherein said method is performed with a robotic liquid-handler.

24. A method, comprising:
(a) end-labeling two or more first subsets of nucleic acids with a detectable oligonucleotide tag to produce nucleic acids within a subset that are identically end-labeled relative to each other and uniquely end-labeled relative to nucleic acids in other subsets;
(b) combining two or more subsets of uniquely end-labeled nucleic acids to form a pool of nucleic acids, wherein the pool comprises two or more second subsets of nucleic acids that are distinct from the two or more first subsets of nucleic acids;
(c) identically end-labeling two or more second subsets of nucleic acids with a second detectable oligonucleotide tag to produce nucleic acids within a second subset that are uniquely labeled relative to nucleic acids in the same or different second subsets; and
(d) repeating steps (b) and (c) until a number of unique end-label combinations is generated that exceeds the number of starting nucleic acids.

25. The method according to paragraph 24, wherein said method is performed in a multi-well plate.

26. The method according to paragraph 24, wherein said method is performed with a robotic liquid-handler.

27. A method, comprising:
(a) providing a pool of nucleic acids;
(b) separating the pool of nucleic acids into sub-pools of nucleic acids;
(c) end-labeling nucleic acids in each sub-pool of with one of $m_1$ detectable oligonucleotide tags thereby producing sub-pools of labeled nucleic acids, wherein nucleic acids in a sub-pool are identically end-labeled to each other;
(d) combining sub-pools of labeled nucleic acids to create a pool of labeled nucleic acids;
(e) separating the pool of labeled nucleic acid molecules into second sub-pools of labeled nucleic acids;
(f) repeating steps (c) to (e) n times to produce nucleic acids end-labeled with n detectable oligonucleotide tags wherein the pool in (a) consists of a number of nucleic acids that is less than $(m_1)(m_2)(m_3) \ldots (m_n)$.

28. The method according to paragraph 27, wherein said method is performed in a multi-well plate.

29. The method according to paragraph 27, wherein said method is performed with a robotic liquid-handler.

30. A method, comprising:
combining a plurality of first nucleic acids, every first nucleic acid in the plurality comprising a common sequence, and a plurality of second nucleic acids, each second nucleic acid region comprising a sequence different from all other second nucleic acids,
wherein the number of second nucleic acids in the plurality of second nucleic acids is greater than the number of first nucleic acids in the plurality of first nucleic acids; and
attaching a first nucleic acid to a second nucleic acid, thereby producing a plurality of nucleic acid labels, wherein every nucleic acid label contains a common first nucleic acid and a different second nucleic acid region.

31. The method according to paragraph 30, wherein said method is performed in a multi-well plate.

32. The method according to paragraph 30, wherein said method is performed with a robotic liquid-handler.

33. A plurality of nucleic acid labels obtainable by the method of paragraph 30.

34. A labeled nucleic acid obtainable by the method of paragraph 1.

35. A method for labeling nucleic acid with a unique label, comprising the steps of:
(a) providing a pool of nucleic acids;
(b) sequentially end-labeling said nucleic acids with a random combination of n detectable oligonucleotide tags, each of said oligonucleotide tags optionally comprising a cohesive overhang of x base pairs in length; and
(c) amplifying the end-labeled nucleic acid formed in step (b)
wherein each detectable oligonucleotide tag is randomly and independently selected from a number of detectable oligonucleotide tags that is less than the number of agents, and n is the number of oligonucleotides attached to an end of said agent.

36. The method of paragraph 35, wherein amplification step (f) comprises the steps of:
(i) attaching an adapter comprising a first sequencing primer to said nucleic acid;
(ii) incubating said nucleic acid in the presence of a transposome comprising a second sequencing primer; and
(iii) performing PCR amplification so as to amplify the ends of said nucleic acid.

37. The method of paragraph 35, wherein amplification step (t) comprises the steps of:
(i) attaching an adapter comprising a first sequencing primer to said nucleic acid;
(ii) performing in vitro transcription using a RNA polymerase;
(iii) performing a reverse transcription using a primer comprising a random nucleotide sequence of a given length flanked by a second sequencing primer or performing a reverse transcription using a primer comprising a nucleotide sequence attached to the 3' end of the nucleic acid; and
(iv) performing PCR amplification so as to amplify the ends of said nucleic acid.

38. The method of paragraph 35, wherein amplification step (f) comprises the steps of:
(i) attaching an adapter comprising a first sequencing primer to said nucleic acid;
(ii) incubating said nucleic acid in fragmentase or a combination of one or more restriction endonucleases so as to liberate the ends of said nucleic acid thereby forming fragments;
(iii) attaching a given number of specific nucleotides to the ends of said fragments; and
(iv) performing PCR amplification on the fragments formed in step (iii) using a second sequencing primer.

39. The method according to paragraph 35, wherein said method is performed in a multi-well plate.

40. The method according to paragraph 35, wherein said method is performed with a robotic liquid-handler.

41. A method of determining the drug sensitivity of a pathogen, the method comprising:
providing a sample comprising a pathogen;
contacting the sample with one or more, or two or more, test compounds, to provide a test sample;
treating the test sample under conditions that release messenger ribonucleic acid (mRNA) from the pathogen into the test sample;
exposing the test sample to a plurality of nucleic acid probes, comprising a plurality of subsets of probes, wherein each subset comprises one or more probes that bind specifically to a target mRNA that is differentially expressed in organisms that are sensitive to a test compound as compared to organisms that are resistant, wherein the exposure occurs for a time and under conditions in which binding between the probe and target mRNA can occur;
determining a level of binding between the probe and target mRNA, thereby determining a level of the target mRNA; and
comparing the level of the target mRNA in the presence of the test compound to a reference level, wherein a difference in the level of target mRNA relative to the reference level of target mRNA indicates whether the pathogen is sensitive or resistant to the test compound,
wherein the probe is uniquely labeled with a detectable oligonucleotide tag, wherein the detectable oligonucleotides tag is comprised of oligonucleotides each having a unique nucleotide sequence, oligonucleotides each comprising a non-nucleic acid detectable moiety, or oligonucleotides each comprising a unique nucleotide sequence and a non-nucleic acid detectable moiety.

42. A method of selecting a treatment for a subject, the method comprising:
optionally identifying a pathogen in a sample obtained from the subject, in a method comprising:
providing a test sample from a subject suspected of being infected with a pathogen;
treating the test sample under conditions that release messenger ribonucleic acid (mRNA);
exposing the test sample to a plurality of nucleic acid probes, comprising a plurality of subsets of probes, wherein each subset comprises one or more probes that bind specifically to a target mRNA that uniquely identifies a pathogen, wherein the exposure occurs for a time and under conditions in which binding between the probe and the target mRNA can occur; and
determining a level of binding between the probe and target mRNA, thereby determining a level of target mRNA;
wherein an increase in the target mRNA of the test sample, relative to a reference sample, indicates the identity of the pathogen in the test sample;
determining the drug sensitivity of the pathogen using the method of paragraph 41; and
selecting a drug to which the pathogen is sensitive for use in treating the subject.

43. A method of monitoring an infection with a pathogen in a subject, the method comprising:
providing a first sample obtained from a subject comprising the pathogen at a first time;
determining the drug sensitivity of the pathogen in the first sample using the method of paragraph 41;
optionally selecting a treatment to which the pathogen is sensitive and administering the selected treatment to the subject;
providing a second sample obtained from a subject comprising the pathogen at a second time;
determining the drug sensitivity of the pathogen in the second sample using the method of paragraph 41; and
comparing the drug sensitivity of the pathogen in the first sample and the second sample, thereby monitoring the infection in the subject.

44. A method of monitoring an infection with a pathogen in a population of subjects, the method comprising:
providing a first plurality of samples obtained from subjects in the population at a first time;
determining the drug sensitivity of pathogens in the first plurality of samples using the method of paragraph 41, and optionally identifying an infectious disease pathogen in the first plurality of samples in a method comprising:

providing a test sample obtained from a subject suspected of being infected with a pathogen;

treating the test sample under conditions that release messenger ribonucleic acid (mRNA);

exposing the test sample to a plurality of nucleic acid probes, comprising a plurality of subsets of probes, wherein each subset comprises one or more probes that bind specifically to a target mRNA that uniquely identifies a pathogen, wherein the exposure occurs for a time and under conditions in which binding between the probe and the target mRNA can occur; and determining a level of binding between the probe and target mRNA, thereby determining a level of target mRNA;

wherein an increase in the target mRNA of the test sample, relative to a reference sample, indicates the identity of the pathogen in the test sample;

providing a second plurality of samples obtained from subjects in the population at a second time, optionally after administration of a treatment to the subjects;

determining the drug sensitivity of pathogens in the second plurality of samples using the method of paragraph 41, and optionally identifying an infectious disease pathogen in the first plurality of samples in a method comprising:

providing a test sample obtained from a subject suspected of being infected with a pathogen;

treating the test sample under conditions that release messenger ribonucleic acid (mRNA);

exposing the test sample to a plurality of nucleic acid probes, comprising a plurality of subsets of probes, wherein each subset comprises one or more probes that bind specifically to a target mRNA that uniquely identifies a pathogen, wherein the exposure occurs for a time and under conditions in which binding between the probe and the target mRNA can occur; and determining a level of binding between the probe and target mRNA, thereby determining a level of target mRNA;

wherein an increase in the target mRNA of the test sample, relative to a reference sample, indicates the identity of the pathogen in the test sample;

comparing the drug sensitivity of the pathogens, and optionally the identity of the pathogens, in the first plurality of samples and the second plurality of samples, thereby monitoring the infection in the population of subject.

45. A method of determining a cell's epigenetic profile, comprising:
  isolating the cell from a population of cells;
  lysing the cell to release chromatin;
  fragmenting the chromatin into DNA-histone complexes;
  ligating the DNA of the DNA-histone complex to a labeled oligo wherein the labeled oligo is generated by the following steps:
  (a) end-labeling two or more first subsets of nucleic acids with a detectable oligonucleotide tag to produce nucleic acids within a subset that are identically end-labeled relative to each other and uniquely end-labeled relative to nucleic acids in other subsets;
  (b) combining two or more subsets of uniquely end-labeled nucleic acids to form a pool of nucleic acids, wherein the pool comprises two or more second subsets of nucleic acids that are distinct from the two or more first subsets of nucleic acids;
  (c) identically end-labeling two or more second subsets of nucleic acids with a second detectable oligonucleotide tag to produce nucleic acids within a second subset that are uniquely labeled relative to nucleic acids in the same or different second subsets; and
  (d) repeating steps (b) and (c) until a number of unique end-label combinations is generated that exceeds the number of starting nucleic acids,
  amplifying the DNA ligated to the labeled oligo in an in vitro transcription reaction; and
  analyzing the amplified DNA, thereby determining the cell's epigenetic profile.

46. The method of paragraph 45, wherein the labeled oligo comprises a T7 promoter.

47. The method of paragraph 45, wherein the labeled oligo is generated on a solid support 48. The method of paragraph 47, wherein the labeled oligo is cleavable from the solid support.

49. The method of paragraph 47, wherein the solid support is a bead.

50. The method of paragraph 45, wherein said method is performed in a multi-well plate.

51. The method of paragraph 45, wherein said method is performed with a robotic liquid-handler.

52. A method of identifying unbiased chromatin interactions across a genome in a cell, comprising:
  crosslinking the genome;
  digesting DNA of the genome with a restriction enzyme to form complexes;
  labeling the complexes with a labeled oligo wherein the labeled oligo is generated by the following steps:
  (a) end-labeling two or more first subsets of nucleic acids with a detectable oligonucleotide tag to produce nucleic acids within a subset that are identically end-labeled relative to each other and uniquely end-labeled relative to nucleic acids in other subsets;
  (b) combining two or more subsets of uniquely end-labeled nucleic acids to form a pool of nucleic acids, wherein the pool comprises two or more second subsets of nucleic acids that are distinct from the two or more first subsets of nucleic acids;
  (c) identically end-labeling two or more second subsets of nucleic acids with a second detectable oligonucleotide tag to produce nucleic acids within a second subset that are uniquely labeled relative to nucleic acids in the same or different second subsets; and
  (d) repeating steps (b) and (c) until a number of unique end-label combinations is generated that exceeds the number of starting nucleic acids; and
  analyzing the labeled complexes, thereby identifying unbiased chromatin interactions across the genome in the cell.

53. The method of paragraph 52, wherein the labeled oligo is generated on a solid support 54. The method of paragraph 53, wherein the labeled oligo is cleavable from the solid support.

55. The method of paragraph 53, wherein the solid support is a bead.

56. The method of paragraph 52, wherein said method is performed in a multi-well plate.

57. The method of paragraph 52, wherein said method is performed with a robotic liquid- handler.

It is to be understood that the invention is not limited to the particular embodiments of the invention described above, as variations of the particular embodiments may be made and still fall within the scope of the appended claims.

SEQUENCE LISTING (2361 sequences)

SEQ ID NO: 1 - DNA, 20 bp, Artificial Sequence
  Description of Artificial Sequence: Synthetic oligonucleotide
ggatatctgtggatatctgt

SEQ ID NO: 2 - DNA, 20 bp, Artificial Sequence
  Description of Artificial Sequence: Synthetic oligonucleotide
ggctgccataggctgccata

SEQ ID NO: 3 - DNA, 20 bp, Artificial Sequence
  Description of Artificial Sequence: Synthetic oligonucleotide
ggtatgtcaaggtatgtcaa

SEQ ID NO: 4 - DNA, 20 bp, Artificial Sequence
  Description of Artificial Sequence: Synthetic oligonucleotide
ggtgaaggacggtgaaggac

SEQ ID NO: 5 - DNA, 20 bp, Artificial Sequence
  Description of Artificial Sequence: Synthetic oligonucleotide
gtaccagcatgtaccagcat

SEQ ID NO: 6 - DNA, 20 bp, Artificial Sequence
  Description of Artificial Sequence: Synthetic oligonucleotide
gtatacatccgtatacatcc

SEQ ID NO: 7 - DNA, 20 bp, Artificial Sequence
  Description of Artificial Sequence: Synthetic oligonucleotide
gtatcgctcagtatcgctca

SEQ ID NO: 8 - DNA, 20 bp, Artificial Sequence
  Description of Artificial Sequence: Synthetic oligonucleotide
gtccgatggagtccgatgga

SEQ ID NO: 9 - DNA, 20 bp, Artificial Sequence
  Description of Artificial Sequence: Synthetic oligonucleotide
gtgtggaattgtgtggaatt

SEQ ID NO: 10 - DNA, 20 bp, Artificial Sequence
  Description of Artificial Sequence: Synthetic oligonucleotide
gtgtggcagagtgtggcaga

SEQ ID NO: 11 - DNA, 20 bp, Artificial Sequence
  Description of Artificial Sequence: Synthetic oligonucleotide
gttacggtgagttacggtga

SEQ ID NO: 12 - DNA, 20 bp, Artificial Sequence
  Description of Artificial Sequence: Synthetic oligonucleotide
gttcgtacatgttcgtacat

SEQ ID NO: 13 - DNA, 20 bp, Artificial Sequence
  Description of Artificial Sequence: Synthetic oligonucleotide
taaccggtaataaccggtaa

SEQ ID NO: 14 - DNA, 20 bp, Artificial Sequence
  Description of Artificial Sequence: Synthetic oligonucleotide
tacagagtcatacagagtca

SEQ ID NO: 15 - DNA, 20 bp, Artificial Sequence
  Description of Artificial Sequence: Synthetic oligonucleotide
taccgagatataccgagata

SEQ ID NO: 16 - DNA, 20 bp, Artificial Sequence
  Description of Artificial Sequence: Synthetic oligonucleotide
tacgcatcgctacgcatcgc

SEQ ID NO: 17 - DNA, 20 bp, Artificial Sequence
  Description of Artificial Sequence: Synthetic oligonucleotide
tacgcgcttgtacgcgcttg

SEQ ID NO: 18 - DNA, 20 bp, Artificial Sequence
  Description of Artificial Sequence: Synthetic oligonucleotide
tagacttcactagacttcac

SEQ ID NO: 19 - DNA, 20 bp, Artificial Sequence
  Description of Artificial Sequence: Synthetic oligonucleotide
tatcgcttagtatcgcttag

SEQ ID NO: 20 - DNA, 20 bp, Artificial Sequence
  Description of Artificial Sequence: Synthetic oligonucleotide
tcacgatccgtcacgatccg

SEQ ID NO: 21 - DNA, 20 bp, Artificial Sequence
  Description of Artificial Sequence: Synthetic oligonucleotide
tcagcttcgctcagcttcgc

SEQ ID NO: 22 - DNA, 20 bp, Artificial Sequence
  Description of Artificial Sequence: Synthetic oligonucleotide
tccggacttctccggacttc

SEQ ID NO: 23 - DNA, 20 bp, Artificial Sequence
  Description of Artificial Sequence: Synthetic oligonucleotide
tccggtatggtccggtatgg

SEQ ID NO: 24 - DNA, 20 bp, Artificial Sequence
  Description of Artificial Sequence: Synthetic oligonucleotide
tccgtggtgatccgtggtga

SEQ ID NO: 25 - DNA, 20 bp, Artificial Sequence
  Description of Artificial Sequence: Synthetic oligonucleotide
tcctcatccatcctcatcca

SEQ ID NO: 26 - DNA, 20 bp, Artificial Sequence
  Description of Artificial Sequence: Synthetic oligonucleotide
tccttctggatccttctgga

SEQ ID NO: 27 - DNA, 20 bp, Artificial Sequence
  Description of Artificial Sequence: Synthetic oligonucleotide
tcgctgttgctcgctgttgc

SEQ ID NO: 28 - DNA, 20 bp, Artificial Sequence
  Description of Artificial Sequence: Synthetic oligonucleotide
tcggagcttgtcggagcttg

SEQ ID NO: 29 - DNA, 20 bp, Artificial Sequence
  Description of Artificial Sequence: Synthetic oligonucleotide
tcggcatgagtcggcatgag

SEQ ID NO: 30 - DNA, 20 bp, Artificial Sequence
  Description of Artificial Sequence: Synthetic oligonucleotide
tcggtggaactcggtggaac

SEQ ID NO: 31 - DNA, 20 bp, Artificial Sequence
  Description of Artificial Sequence: Synthetic oligonucleotide
tcggttgtaatcggttgtaa

SEQ ID NO: 32 - DNA, 20 bp, Artificial Sequence
  Description of Artificial Sequence: Synthetic oligonucleotide
tcgtgtggcatcgtgtggca

SEQ ID NO: 33 - DNA, 20 bp, Artificial Sequence
  Description of Artificial Sequence: Synthetic oligonucleotide
tctgttccgctctgttccgc

SEQ ID NO: 34 - DNA, 20 bp, Artificial Sequence
  Description of Artificial Sequence: Synthetic oligonucleotide
tcttggcgtctcttggcgtc

SEQ ID NO: 35 - DNA, 20 bp, Artificial Sequence
  Description of Artificial Sequence: Synthetic oligonucleotide
tgattgagtctgattgagtc

SEQ ID NO: 36 - DNA, 20 bp, Artificial Sequence
  Description of Artificial Sequence: Synthetic oligonucleotide
tgcgttggcatgcgttggca

SEQ ID NO: 37 - DNA, 20 bp, Artificial Sequence
  Description of Artificial Sequence: Synthetic oligonucleotide
tggacatgcgtggacatgcg

SEQ ID NO: 38 - DNA, 20 bp, Artificial Sequence
  Description of Artificial Sequence: Synthetic oligonucleotide
tggcaagccatggcaagcca

SEQ ID NO: 39 - DNA, 20 bp, Artificial Sequence
  Description of Artificial Sequence: Synthetic oligonucleotide
tggttaactgtggttaactg

SEQ ID NO: 40 - DNA, 20 bp, Artificial Sequence
  Description of Artificial Sequence: Synthetic oligonucleotide
tgtacctgagtgtacctgag

SEQ ID NO: 41 - DNA, 20 bp, Artificial Sequence
  Description of Artificial Sequence: Synthetic oligonucleotide
tgtactacagtgtactacag

SEQ ID NO: 42 - DNA, 20 bp, Artificial Sequence
  Description of Artificial Sequence: Synthetic oligonucleotide
tgtcggttgctgtcggttgc

SEQ ID NO: 43 - DNA, 20 bp, Artificial Sequence
  Description of Artificial Sequence: Synthetic oligonucleotide
tgtctgtcggtgtctgtcgg

SEQ ID NO: 44 - DNA, 20 bp, Artificial Sequence
  Description of Artificial Sequence: Synthetic oligonucleotide
tgtgactatctgtgactatc

SEQ ID NO: 45 - DNA, 20 bp, Artificial Sequence
  Description of Artificial Sequence: Synthetic oligonucleotide
tgtgagtgcgtgtgagtgcg

SEQ ID NO: 46 - DNA, 20 bp, Artificial Sequence
  Description of Artificial Sequence: Synthetic oligonucleotide
tgtggttcgctgtggttcgc

SEQ ID NO: 47 - DNA, 20 bp, Artificial Sequence
  Description of Artificial Sequence: Synthetic oligonucleotide
tgttctctactgttctctac

SEQ ID NO: 48 - DNA, 20 bp, Artificial Sequence
  Description of Artificial Sequence: Synthetic oligonucleotide
ttagccagtcttagccagtc

SEQ ID NO: 49 - DNA, 20 bp, Artificial Sequence
  Description of Artificial Sequence: Synthetic oligonucleotide
ttcgcgaatattcgcgaata

SEQ ID NO: 50 - DNA, 20 bp, Artificial Sequence
  Description of Artificial Sequence: Synthetic oligonucleotide
ttcgcggtacttcgcggtac

SEQ ID NO: 51 - DNA, 20 bp, Artificial Sequence
  Description of Artificial Sequence: Synthetic oligonucleotide
ttctatgcagttctatgcag

SEQ ID NO: 52 - DNA, 20 bp, Artificial Sequence
  Description of Artificial Sequence: Synthetic oligonucleotide
ttcttaccgattcttaccga

SEQ ID NO: 53 - DNA, 20 bp, Artificial Sequence
  Description of Artificial Sequence: Synthetic oligonucleotide
ttgctctggattgctctgga

SEQ ID NO: 54 - DNA, 20 bp, Artificial Sequence
  Description of Artificial Sequence: Synthetic oligonucleotide
ttgtaacaccttgtaacacc

SEQ ID NO: 55 - DNA, 20 bp, Artificial Sequence
  Description of Artificial Sequence: Synthetic oligonucleotide
aacaagttccaacaagttcc

SEQ ID NO: 56 - DNA, 20 bp, Artificial Sequence
  Description of Artificial Sequence: Synthetic oligonucleotide
aacagcacgcaacagcacgc

SEQ ID NO: 57 - DNA, 20 bp, Artificial Sequence
  Description of Artificial Sequence: Synthetic oligonucleotide
aacgtgcggtaacgtgcggt

SEQ ID NO: 58 - DNA, 20 bp, Artificial Sequence
  Description of Artificial Sequence: Synthetic oligonucleotide
aagagcgatgaagagcgatg

SEQ ID NO: 59 - DNA, 20 bp, Artificial Sequence
  Description of Artificial Sequence: Synthetic oligonucleotide
aaggaattccaaggaattcc

SEQ ID NO: 60 - DNA, 20 bp, Artificial Sequence
  Description of Artificial Sequence: Synthetic oligonucleotide
aagtgaggcgaagtgaggcg

SEQ ID NO: 61 - DNA, 20 bp, Artificial Sequence
  Description of Artificial Sequence: Synthetic oligonucleotide
aatacgcgataatacgcgat

SEQ ID NO: 62 - DNA, 20 bp, Artificial Sequence
  Description of Artificial Sequence: Synthetic oligonucleotide
aataggttggaataggttgg

SEQ ID NO: 63 - DNA, 20 bp, Artificial Sequence
  Description of Artificial Sequence: Synthetic oligonucleotide
aatcgaagctaatcgaagct

SEQ ID NO: 64 - DNA, 20 bp, Artificial Sequence
  Description of Artificial Sequence: Synthetic oligonucleotide
acactacgatacactacgat

SEQ ID NO: 65 - DNA, 20 bp, Artificial Sequence
  Description of Artificial Sequence: Synthetic oligonucleotide
acactcagccacactcagcc

SEQ ID NO: 66 - DNA, 20 bp, Artificial Sequence
  Description of Artificial Sequence: Synthetic oligonucleotide
acatcgagccacatcgagcc

SEQ ID NO: 67 - DNA, 20 bp, Artificial Sequence
  Description of Artificial Sequence: Synthetic oligonucleotide
acattatgcgacattatgcg

SEQ ID NO: 68 - DNA, 20 bp, Artificial Sequence
  Description of Artificial Sequence: Synthetic oligonucleotide
accagcaactaccagcaact

SEQ ID NO: 69 - DNA, 20 bp, Artificial Sequence
  Description of Artificial Sequence: Synthetic oligonucleotide
accgaacacgaccgaacacg

SEQ ID NO: 70 - DNA, 20 bp, Artificial Sequence
  Description of Artificial Sequence: Synthetic oligonucleotide
accgaacggtaccgaacggt

SEQ ID NO: 71 - DNA, 20 bp, Artificial Sequence
  Description of Artificial Sequence: Synthetic oligonucleotide
acgagtggctacgagtggct

SEQ ID NO: 72 - DNA, 20 bp, Artificial Sequence
  Description of Artificial Sequence: Synthetic oligonucleotide
acggttacggacggttacgg

SEQ ID NO: 73 - DNA, 20 bp, Artificial Sequence
  Description of Artificial Sequence: Synthetic oligonucleotide
acgtaagcgcacgtaagcgc

SEQ ID NO: 74 - DNA, 20 bp, Artificial Sequence
  Description of Artificial Sequence: Synthetic oligonucleotide
actatgtgctactatgtgct

SEQ ID NO: 75 - DNA, 20 bp, Artificial Sequence
  Description of Artificial Sequence: Synthetic oligonucleotide
actggagtccactggagtcc

SEQ ID NO: 76 - DNA, 20 bp, Artificial Sequence
  Description of Artificial Sequence: Synthetic oligonucleotide
actgtacttcactgtacttc

SEQ ID NO: 77 - DNA, 20 bp, Artificial Sequence
  Description of Artificial Sequence: Synthetic oligonucleotide
agaagtctgcagaagtctgc

SEQ ID NO: 78 - DNA, 20 bp, Artificial Sequence
  Description of Artificial Sequence: Synthetic oligonucleotide
agacgcgagtagacgcgagt

SEQ ID NO: 79 - DNA, 20 bp, Artificial Sequence
  Description of Artificial Sequence: Synthetic oligonucleotide
agactgtgctagactgtgct

SEQ ID NO: 80 - DNA, 20 bp, Artificial Sequence
  Description of Artificial Sequence: Synthetic oligonucleotide
agagtacgccagagtacgcc

SEQ ID NO: 81 - DNA, 20 bp, Artificial Sequence
  Description of Artificial Sequence: Synthetic oligonucleotide
agatcgactgagatcgactg

SEQ ID NO: 82 - DNA, 20 bp, Artificial Sequence
  Description of Artificial Sequence: Synthetic oligonucleotide
agattcggccagattcggcc

SEQ ID NO: 83 - DNA, 20 bp, Artificial Sequence
  Description of Artificial Sequence: Synthetic oligonucleotide
agcaagtgctagcaagtgct

SEQ ID NO: 84 - DNA, 20 bp, Artificial Sequence
  Description of Artificial Sequence: Synthetic oligonucleotide
agccattgcgagccattgcg

SEQ ID NO: 85 - DNA, 20 bp, Artificial Sequence
  Description of Artificial Sequence: Synthetic oligonucleotide
agcggacagtagcggacagt

SEQ ID NO: 86 - DNA, 20 bp, Artificial Sequence
  Description of Artificial Sequence: Synthetic oligonucleotide
agcgtaagcgagcgtaagcg

SEQ ID NO: 87 - DNA, 20 bp, Artificial Sequence
  Description of Artificial Sequence: Synthetic oligonucleotide
agctattctcagctattctc

SEQ ID NO: 88 - DNA, 20 bp, Artificial Sequence
  Description of Artificial Sequence: Synthetic oligonucleotide
agcttatacgagcttatacg

SEQ ID NO: 89 - DNA, 20 bp, Artificial Sequence
  Description of Artificial Sequence: Synthetic oligonucleotide
aggacagatgaggacagatg

SEQ ID NO: 90 - DNA, 20 bp, Artificial Sequence
  Description of Artificial Sequence: Synthetic oligonucleotide
aggatcagataggatcagat

SEQ ID NO: 91 - DNA, 20 bp, Artificial Sequence
  Description of Artificial Sequence: Synthetic oligonucleotide
aggctgaaggaggctgaagg

SEQ ID NO: 92 - DNA, 20 bp, Artificial Sequence
  Description of Artificial Sequence: Synthetic oligonucleotide
aggtacgaggaggtacgagg

SEQ ID NO: 93 - DNA, 20 bp, Artificial Sequence
  Description of Artificial Sequence: Synthetic oligonucleotide
aggtaggctcaggtaggctc

SEQ ID NO: 94 - DNA, 20 bp, Artificial Sequence
  Description of Artificial Sequence: Synthetic oligonucleotide
aggtgaacggaggtgaacgg

SEQ ID NO: 95 - DNA, 20 bp, Artificial Sequence
  Description of Artificial Sequence: Synthetic oligonucleotide
aggtgccaataggtgccaat

SEQ ID NO: 96 - DNA, 20 bp, Artificial Sequence
  Description of Artificial Sequence: Synthetic oligonucleotide
aggttcaacgaggttcaacg

SEQ ID NO: 97 - DNA, 20 bp, Artificial Sequence
  Description of Artificial Sequence: Synthetic oligonucleotide
agtcactcgcagtcactcgc

SEQ ID NO: 98 - DNA, 20 bp, Artificial Sequence
  Description of Artificial Sequence: Synthetic oligonucleotide
agtcgtggtgagtcgtggtg

SEQ ID NO: 99 - DNA, 20 bp, Artificial Sequence
  Description of Artificial Sequence: Synthetic oligonucleotide
agtggaggagagtggaggag

SEQ ID NO: 100 - DNA, 20 bp, Artificial Sequence
  Description of Artificial Sequence: Synthetic oligonucleotide
agttgagcgcagttgagcgc

SEQ ID NO: 101 - DNA, 20 bp, Artificial Sequence
  Description of Artificial Sequence: Synthetic oligonucleotide
agttgatggtagttgatggt

SEQ ID NO: 102 - DNA, 20 bp, Artificial Sequence
  Description of Artificial Sequence: Synthetic oligonucleotide
ataacacagcataacacagc

SEQ ID NO: 103 - DNA, 20 bp, Artificial Sequence
  Description of Artificial Sequence: Synthetic oligonucleotide
ataaggtccgataaggtccg

SEQ ID NO: 104 - DNA, 20 bp, Artificial Sequence
  Description of Artificial Sequence: Synthetic oligonucleotide
atacagtcagatacagtcag

SEQ ID NO: 105 - DNA, 20 bp, Artificial Sequence
  Description of Artificial Sequence: Synthetic oligonucleotide
ataccggcctataccggcct

SEQ ID NO: 106 - DNA, 20 bp, Artificial Sequence
  Description of Artificial Sequence: Synthetic oligonucleotide
atagcaggatatagcaggat

SEQ ID NO: 107 - DNA, 20 bp, Artificial Sequence
  Description of Artificial Sequence: Synthetic oligonucleotide
atagcgttacatagcgttac

SEQ ID NO: 108 - DNA, 20 bp, Artificial Sequence
  Description of Artificial Sequence: Synthetic oligonucleotide
atagtccaacatagtccaac

SEQ ID NO: 109 - DNA, 20 bp, Artificial Sequence
  Description of Artificial Sequence: Synthetic oligonucleotide
atatcggcggatatcggcgg

SEQ ID NO: 110 - DNA, 20 bp, Artificial Sequence
  Description of Artificial Sequence: Synthetic oligonucleotide
atccgtgatgatccgtgatg

SEQ ID NO: 111 - DNA, 20 bp, Artificial Sequence
  Description of Artificial Sequence: Synthetic oligonucleotide
atcgtaccggatcgtaccgg

SEQ ID NO: 112 - DNA, 20 bp, Artificial Sequence
  Description of Artificial Sequence: Synthetic oligonucleotide
atcgttactgatcgttactg

SEQ ID NO: 113 - DNA, 20 bp, Artificial Sequence
  Description of Artificial Sequence: Synthetic oligonucleotide
atgaagatgcatgaagatgc

SEQ ID NO: 114 - DNA, 20 bp, Artificial Sequence
  Description of Artificial Sequence: Synthetic oligonucleotide
atggcgtggtatggcgtggt

SEQ ID NO: 115 - DNA, 20 bp, Artificial Sequence
  Description of Artificial Sequence: Synthetic oligonucleotide
atgttgagcgatgttgagcg

SEQ ID NO: 116 - DNA, 20 bp, Artificial Sequence
  Description of Artificial Sequence: Synthetic oligonucleotide
attagctgtcattagctgtc

SEQ ID NO: 117 - DNA, 20 bp, Artificial Sequence
  Description of Artificial Sequence: Synthetic oligonucleotide
attcgcgtgcattcgcgtgc

SEQ ID NO: 118 - DNA, 20 bp, Artificial Sequence
  Description of Artificial Sequence: Synthetic oligonucleotide
attgcgctccattgcgctcc

SEQ ID NO: 119 - DNA, 20 bp, Artificial Sequence
  Description of Artificial Sequence: Synthetic oligonucleotide
attgtgttgcattgtgttgc

SEQ ID NO: 120 - DNA, 20 bp, Artificial Sequence
  Description of Artificial Sequence: Synthetic oligonucleotide
caagacgaatcaagacgaat

SEQ ID NO: 121 - DNA, 20 bp, Artificial Sequence
  Description of Artificial Sequence: Synthetic oligonucleotide
cacgcactgtcacgcactgt

SEQ ID NO: 122 - DNA, 20 bp, Artificial Sequence
  Description of Artificial Sequence: Synthetic oligonucleotide
cacggagtagcacggagtag

SEQ ID NO: 123 - DNA, 20 bp, Artificial Sequence
  Description of Artificial Sequence: Synthetic oligonucleotide
cacggtatcgcacggtatcg

SEQ ID NO: 124 - DNA, 20 bp, Artificial Sequence
  Description of Artificial Sequence: Synthetic oligonucleotide
cactcggattcactcggatt

SEQ ID NO: 125 - DNA, 20 bp, Artificial Sequence
  Description of Artificial Sequence: Synthetic oligonucleotide
cacttgagtacacttgagta

SEQ ID NO: 126 - DNA, 20 bp, Artificial Sequence
  Description of Artificial Sequence: Synthetic oligonucleotide
cagcctcagtcagcctcagt

SEQ ID NO: 127 - DNA, 20 bp, Artificial Sequence
  Description of Artificial Sequence: Synthetic oligonucleotide
cagctccaagcagctccaag

SEQ ID NO: 128 - DNA, 20 bp, Artificial Sequence
  Description of Artificial Sequence: Synthetic oligonucleotide
catcgaggagcatcgaggag

SEQ ID NO: 129 - DNA, 20 bp, Artificial Sequence
  Description of Artificial Sequence: Synthetic oligonucleotide
cattggccgtcattggccgt

SEQ ID NO: 130 - DNA, 20 bp, Artificial Sequence
  Description of Artificial Sequence: Synthetic oligonucleotide
ccagaactggccagaactgg

SEQ ID NO: 131 - DNA, 20 bp, Artificial Sequence
  Description of Artificial Sequence: Synthetic oligonucleotide
ccagatacggccagatacgg

SEQ ID NO: 132 - DNA, 20 bp, Artificial Sequence
  Description of Artificial Sequence: Synthetic oligonucleotide
ccaggatccaccaggatcca

SEQ ID NO: 133 - DNA, 20 bp, Artificial Sequence
  Description of Artificial Sequence: Synthetic oligonucleotide
ccaggatgttccaggatgtt

SEQ ID NO: 134 - DNA, 20 bp, Artificial Sequence
  Description of Artificial Sequence: Synthetic oligonucleotide
ccgagcatgtccgagcatgt

SEQ ID NO: 135 - DNA, 20 bp, Artificial Sequence
  Description of Artificial Sequence: Synthetic oligonucleotide
ccggagtgttccggagtgtt

SEQ ID NO: 136 - DNA, 20 bp, Artificial Sequence
  Description of Artificial Sequence: Synthetic oligonucleotide
ccggtaccatccggtaccat

SEQ ID NO: 137 - DNA, 20 bp, Artificial Sequence
  Description of Artificial Sequence: Synthetic oligonucleotide
ccgtctaaggccgtctaagg

SEQ ID NO: 138 - DNA, 20 bp, Artificial Sequence
  Description of Artificial Sequence: Synthetic oligonucleotide
cctccattaacctccattaa

SEQ ID NO: 139 - DNA, 20 bp, Artificial Sequence
  Description of Artificial Sequence: Synthetic oligonucleotide
cctcctgactcctcctgact

SEQ ID NO: 140 - DNA, 20 bp, Artificial Sequence
  Description of Artificial Sequence: Synthetic oligonucleotide
cctctgctctcctctgctct

SEQ ID NO: 141 - DNA, 20 bp, Artificial Sequence
  Description of Artificial Sequence: Synthetic oligonucleotide
cctgccttgtcctgccttgt

SEQ ID NO: 142 - DNA, 20 bp, Artificial Sequence
  Description of Artificial Sequence: Synthetic oligonucleotide
cctggccattcctggccatt

SEQ ID NO: 143 - DNA, 20 bp, Artificial Sequence
  Description of Artificial Sequence: Synthetic oligonucleotide
ccttaacgcgccttaacgcg

SEQ ID NO: 144 - DNA, 20 bp, Artificial Sequence
  Description of Artificial Sequence: Synthetic oligonucleotide
cgacctgtctcgacctgtct

SEQ ID NO: 145 - DNA, 20 bp, Artificial Sequence
  Description of Artificial Sequence: Synthetic oligonucleotide
cgcgttacgtcgcgttacgt

SEQ ID NO: 146 - DNA, 20 bp, Artificial Sequence
  Description of Artificial Sequence: Synthetic oligonucleotide
cggcagttcacggcagttca

SEQ ID NO: 147 - DNA, 20 bp, Artificial Sequence
  Description of Artificial Sequence: Synthetic oligonucleotide
cggccattagcggccattag

SEQ ID NO: 148 - DNA, 20 bp, Artificial Sequence
  Description of Artificial Sequence: Synthetic oligonucleotide
cgtattgcatcgtattgcat

SEQ ID NO: 149 - DNA, 20 bp, Artificial Sequence
  Description of Artificial Sequence: Synthetic oligonucleotide
ctacgaccgtctacgaccgt

SEQ ID NO: 150 - DNA, 20 bp, Artificial Sequence
  Description of Artificial Sequence: Synthetic oligonucleotide
ctaggaaggtctaggaaggt

SEQ ID NO: 151 - DNA, 20 bp, Artificial Sequence
  Description of Artificial Sequence: Synthetic oligonucleotide
ctagtcctgtctagtcctgt

SEQ ID NO: 152 - DNA, 20 bp, Artificial Sequence
  Description of Artificial Sequence: Synthetic oligonucleotide
ctagtggaggctagtggagg

SEQ ID NO: 153 - DNA, 20 bp, Artificial Sequence
  Description of Artificial Sequence: Synthetic oligonucleotide
ctcgcagagtctcgcagagt

SEQ ID NO: 154 - DNA, 20 bp, Artificial Sequence
  Description of Artificial Sequence: Synthetic oligonucleotide
ctcgcttcgtctcgcttcgt

SEQ ID NO: 155 - DNA, 20 bp, Artificial Sequence
  Description of Artificial Sequence: Synthetic oligonucleotide
ctcgttagcgctcgttagcg

SEQ ID NO: 156 - DNA, 20 bp, Artificial Sequence
  Description of Artificial Sequence: Synthetic oligonucleotide
ctcttccaagctcttccaag

SEQ ID NO: 157 - DNA, 20 bp, Artificial Sequence
  Description of Artificial Sequence: Synthetic oligonucleotide
ctgcttcaatctgcttcaat

SEQ ID NO: 158 - DNA, 20 bp, Artificial Sequence
  Description of Artificial Sequence: Synthetic oligonucleotide
ctggtatcaactggtatcaa

SEQ ID NO: 159 - DNA, 20 bp, Artificial Sequence
  Description of Artificial Sequence: Synthetic oligonucleotide
ctgtcttcggctgtcttcgg

SEQ ID NO: 160 - DNA, 20 bp, Artificial Sequence
  Description of Artificial Sequence: Synthetic oligonucleotide
cttcatgacgcttcatgacg

SEQ ID NO: 161 - DNA, 20 bp, Artificial Sequence
  Description of Artificial Sequence: Synthetic oligonucleotide
cttcggcagtcttcggcagt

SEQ ID NO: 162 - DNA, 20 bp, Artificial Sequence
  Description of Artificial Sequence: Synthetic oligonucleotide
cttgaccggtcttgaccggt

SEQ ID NO: 163 - DNA, 20 bp, Artificial Sequence
  Description of Artificial Sequence: Synthetic oligonucleotide
cttgcctattcttgcctatt

SEQ ID NO: 164 - DNA, 20 bp, Artificial Sequence
  Description of Artificial Sequence: Synthetic oligonucleotide
gaacttgtgagaacttgtga

SEQ ID NO: 165 - DNA, 20 bp, Artificial Sequence
  Description of Artificial Sequence: Synthetic oligonucleotide
gaagcattctgaagcattct

SEQ ID NO: 166 - DNA, 20 bp, Artificial Sequence
  Description of Artificial Sequence: Synthetic oligonucleotide
gaatccattcgaatccattc

SEQ ID NO: 167 - DNA, 20 bp, Artificial Sequence
  Description of Artificial Sequence: Synthetic oligonucleotide
gacgcctgttgacgcctgtt

SEQ ID NO: 168 - DNA, 20 bp, Artificial Sequence
  Description of Artificial Sequence: Synthetic oligonucleotide
gacgtaggacgacgtaggac

SEQ ID NO: 169 - DNA, 20 bp, Artificial Sequence
  Description of Artificial Sequence: Synthetic oligonucleotide
gactaatggtgactaatggt

SEQ ID NO: 170 - DNA, 20 bp, Artificial Sequence
  Description of Artificial Sequence: Synthetic oligonucleotide
gagcctccttgagcctcctt

SEQ ID NO: 171 - DNA, 20 bp, Artificial Sequence
  Description of Artificial Sequence: Synthetic oligonucleotide
gagcgtctacgagcgtctac

SEQ ID NO: 172 - DNA, 20 bp, Artificial Sequence
  Description of Artificial Sequence: Synthetic oligonucleotide
gaggataggcgaggataggc

SEQ ID NO: 173 - DNA, 20 bp, Artificial Sequence
  Description of Artificial Sequence: Synthetic oligonucleotide
gagtgccatcgagtgccatc

SEQ ID NO: 174 - DNA, 20 bp, Artificial Sequence
  Description of Artificial Sequence: Synthetic oligonucleotide
gagtggatctgagtggatct

SEQ ID NO: 175 - DNA, 20 bp, Artificial Sequence
  Description of Artificial Sequence: Synthetic oligonucleotide
gagtggtagcgagtggtagc

SEQ ID NO: 176 - DNA, 20 bp, Artificial Sequence
  Description of Artificial Sequence: Synthetic oligonucleotide
gagttagagagagttagaga

SEQ ID NO: 177 - DNA, 20 bp, Artificial Sequence
  Description of Artificial Sequence: Synthetic oligonucleotide
gcacatctgcgcacatctgc

SEQ ID NO: 178 - DNA, 20 bp, Artificial Sequence
  Description of Artificial Sequence: Synthetic oligonucleotide
gcaccattacgcaccattac

SEQ ID NO: 179 - DNA, 20 bp, Artificial Sequence
  Description of Artificial Sequence: Synthetic oligonucleotide
gcagcctattgcagcctatt

SEQ ID NO: 180 - DNA, 20 bp, Artificial Sequence
  Description of Artificial Sequence: Synthetic oligonucleotide
gcagtatcaagcagtatcaa

SEQ ID NO: 181 - DNA, 20 bp, Artificial Sequence
  Description of Artificial Sequence: Synthetic oligonucleotide
gccgtcgttagccgtcgtta

SEQ ID NO: 182 - DNA, 20 bp, Artificial Sequence
  Description of Artificial Sequence: Synthetic oligonucleotide
gcctgagctagcctgagcta

SEQ ID NO: 183 - DNA, 20 bp, Artificial Sequence
  Description of Artificial Sequence: Synthetic oligonucleotide
gcgcaagcaagcgcaagcaa

SEQ ID NO: 184 - DNA, 20 bp, Artificial Sequence
  Description of Artificial Sequence: Synthetic oligonucleotide
gcgttacgacgcgttacgac

SEQ ID NO: 185 - DNA, 20 bp, Artificial Sequence
  Description of Artificial Sequence: Synthetic oligonucleotide
gcgttggatcgcgttggatc

SEQ ID NO: 186 - DNA, 20 bp, Artificial Sequence
  Description of Artificial Sequence: Synthetic oligonucleotide
gctagtcgcagctagtcgca

SEQ ID NO: 187 - DNA, 20 bp, Artificial Sequence
  Description of Artificial Sequence: Synthetic oligonucleotide
gctcactaccgctcactacc

SEQ ID NO: 188 - DNA, 20 bp, Artificial Sequence
  Description of Artificial Sequence: Synthetic oligonucleotide
gctcgaattagctcgaatta

SEQ ID NO: 189 - DNA, 20 bp, Artificial Sequence
  Description of Artificial Sequence: Synthetic oligonucleotide
gctcgattccgctcgattcc

SEQ ID NO: 190 - DNA, 20 bp, Artificial Sequence
  Description of Artificial Sequence: Synthetic oligonucleotide
gctgaggatcgctgaggatc

SEQ ID NO: 191 - DNA, 20 bp, Artificial Sequence
  Description of Artificial Sequence: Synthetic oligonucleotide
gcttcattctgcttcattct

SEQ ID NO: 192 - DNA, 20 bp, Artificial Sequence
  Description of Artificial Sequence: Synthetic oligonucleotide
gcttgctattgcttgctatt

SEQ ID NO: 193 - DNA, 20 bp, Artificial Sequence
  Description of Artificial Sequence: Synthetic oligonucleotide
gcttggttgcgcttggttgc

SEQ ID NO: 194 - DNA, 20 bp, Artificial Sequence
  Description of Artificial Sequence: Synthetic oligonucleotide
ggagtggttcggagtggttc

SEQ ID NO: 195 - DNA, 20 bp, Artificial Sequence
  Description of Artificial Sequence: Synthetic oligonucleotide
ggataataccggataatacc

SEQ ID NO: 196 - DNA, 20 bp, Artificial Sequence
  Description of Artificial Sequence: Synthetic oligonucleotide
ggatcgtggtggatcgtggt

SEQ ID NO: 197 - DNA, 20 bp, Artificial Sequence
  Description of Artificial Sequence: Synthetic oligonucleotide
ggatgattgtggatgattgt

SEQ ID NO: 198 - DNA, 20 bp, Artificial Sequence
  Description of Artificial Sequence: Synthetic oligonucleotide
ggatgcgttcggatgcgttc

SEQ ID NO: 199 - DNA, 20 bp, Artificial Sequence
  Description of Artificial Sequence: Synthetic oligonucleotide
ggcgaatgtcggcgaatgtc

SEQ ID NO: 200 - DNA, 20 bp, Artificial Sequence
  Description of Artificial Sequence: Synthetic oligonucleotide
ggcgattggtggcgattggt

SEQ ID NO: 201 - DNA, 20 bp, Artificial Sequence
  Description of Artificial Sequence: Synthetic oligonucleotide
ggcggtatcaggcggtatca

SEQ ID NO: 202 - DNA, 20 bp, Artificial Sequence
  Description of Artificial Sequence: Synthetic oligonucleotide
ggctatccacggctatccac

SEQ ID NO: 203 - DNA, 20 bp, Artificial Sequence
  Description of Artificial Sequence: Synthetic oligonucleotide
ggctattacaggctattaca

SEQ ID NO: 204 - DNA, 20 bp, Artificial Sequence
  Description of Artificial Sequence: Synthetic oligonucleotide
ggctgaactcggctgaactc

SEQ ID NO: 205 - DNA, 20 bp, Artificial Sequence
  Description of Artificial Sequence: Synthetic oligonucleotide
ggtacagtcaggtacagtca

SEQ ID NO: 206 - DNA, 20 bp, Artificial Sequence
  Description of Artificial Sequence: Synthetic oligonucleotide
ggtcgaacctggtcgaacct

SEQ ID NO: 207 - DNA, 20 bp, Artificial Sequence
  Description of Artificial Sequence: Synthetic oligonucleotide
ggtctctcgtggtctctcgt

SEQ ID NO: 208 - DNA, 20 bp, Artificial Sequence
  Description of Artificial Sequence: Synthetic oligonucleotide
ggtgcttgtcggtgcttgtc

SEQ ID NO: 209 - DNA, 20 bp, Artificial Sequence
  Description of Artificial Sequence: Synthetic oligonucleotide
ggttccacttggttccactt

SEQ ID NO: 210 - DNA, 20 bp, Artificial Sequence
  Description of Artificial Sequence: Synthetic oligonucleotide
ggttgcatccggttgcatcc

SEQ ID NO: 211 - DNA, 20 bp, Artificial Sequence
  Description of Artificial Sequence: Synthetic oligonucleotide
ggttggacgtggttggacgt

SEQ ID NO: 212 - DNA, 20 bp, Artificial Sequence
  Description of Artificial Sequence: Synthetic oligonucleotide
gtaagagcaagtaagagcaa

SEQ ID NO: 213 - DNA, 20 bp, Artificial Sequence
  Description of Artificial Sequence: Synthetic oligonucleotide
gtaaggcttagtaaggctta

SEQ ID NO: 214 - DNA, 20 bp, Artificial Sequence
  Description of Artificial Sequence: Synthetic oligonucleotide
gtagtcctcagtagtcctca

SEQ ID NO: 215 - DNA, 20 bp, Artificial Sequence
  Description of Artificial Sequence: Synthetic oligonucleotide
gtccggttctgtccggttct

SEQ ID NO: 216 - DNA, 20 bp, Artificial Sequence
  Description of Artificial Sequence: Synthetic oligonucleotide
gtcctacagcgtcctacagc

SEQ ID NO: 217 - DNA, 20 bp, Artificial Sequence
  Description of Artificial Sequence: Synthetic oligonucleotide
gtcggattaagtcggattaa

SEQ ID NO: 218 - DNA, 20 bp, Artificial Sequence
  Description of Artificial Sequence: Synthetic oligonucleotide
gtgaacagaagtgaacagaa

SEQ ID NO: 219 - DNA, 20 bp, Artificial Sequence
  Description of Artificial Sequence: Synthetic oligonucleotide
gtgcctacacgtgcctacac

SEQ ID NO: 220 - DNA, 20 bp, Artificial Sequence
  Description of Artificial Sequence: Synthetic oligonucleotide
gtgtatcggagtgtatcgga

SEQ ID NO: 221 - DNA, 20 bp, Artificial Sequence
  Description of Artificial Sequence: Synthetic oligonucleotide
gtgtccatgagtgtccatga

SEQ ID NO: 222 - DNA, 20 bp, Artificial Sequence
  Description of Artificial Sequence: Synthetic oligonucleotide
gtgtctaatcgtgtctaatc

SEQ ID NO: 223 - DNA, 20 bp, Artificial Sequence
  Description of Artificial Sequence: Synthetic oligonucleotide
gtgttcctgcgtgttcctgc

SEQ ID NO: 224 - DNA, 20 bp, Artificial Sequence
  Description of Artificial Sequence: Synthetic oligonucleotide
gtgttctgctgtgttctgct

SEQ ID NO: 225 - DNA, 20 bp, Artificial Sequence
  Description of Artificial Sequence: Synthetic oligonucleotide
gttaagaggagttaagagga

SEQ ID NO: 226 - DNA, 20 bp, Artificial Sequence
  Description of Artificial Sequence: Synthetic oligonucleotide
gttaatgcgtgttaatgcgt

SEQ ID NO: 227 - DNA, 20 bp, Artificial Sequence
  Description of Artificial Sequence: Synthetic oligonucleotide
gttaggctgtgttaggctgt

SEQ ID NO: 228 - DNA, 20 bp, Artificial Sequence
  Description of Artificial Sequence: Synthetic oligonucleotide
gttcattggagttcattgga

SEQ ID NO: 229 - DNA, 20 bp, Artificial Sequence
  Description of Artificial Sequence: Synthetic oligonucleotide
gttcggaccagttcggacca

SEQ ID NO: 230 - DNA, 20 bp, Artificial Sequence
  Description of Artificial Sequence: Synthetic oligonucleotide
gttggccagtgttggccagt

SEQ ID NO: 231 - DNA, 20 bp, Artificial Sequence
  Description of Artificial Sequence: Synthetic oligonucleotide
gttggtagttgttggtagtt

SEQ ID NO: 232 - DNA, 20 bp, Artificial Sequence
  Description of Artificial Sequence: Synthetic oligonucleotide
taacacgacataacacgaca

SEQ ID NO: 233 - DNA, 20 bp, Artificial Sequence
  Description of Artificial Sequence: Synthetic oligonucleotide
taagagagcataagagagca

SEQ ID NO: 234 - DNA, 20 bp, Artificial Sequence
  Description of Artificial Sequence: Synthetic oligonucleotide
taagaggcggtaagaggcgg

SEQ ID NO: 235 - DNA, 20 bp, Artificial Sequence
  Description of Artificial Sequence: Synthetic oligonucleotide
taaggaatggtaaggaatgg

SEQ ID NO: 236 - DNA, 20 bp, Artificial Sequence
  Description of Artificial Sequence: Synthetic oligonucleotide
taatgagcactaatgagcac

SEQ ID NO: 237 - DNA, 20 bp, Artificial Sequence
  Description of Artificial Sequence: Synthetic oligonucleotide
tacactggtctacactggtc

SEQ ID NO: 238 - DNA, 20 bp, Artificial Sequence
  Description of Artificial Sequence: Synthetic oligonucleotide
tacagcgcaatacagcgcaa

SEQ ID NO: 239 - DNA, 20 bp, Artificial Sequence
  Description of Artificial Sequence: Synthetic oligonucleotide
tacaggttagtacaggttag

SEQ ID NO: 240 - DNA, 20 bp, Artificial Sequence
  Description of Artificial Sequence: Synthetic oligonucleotide
tacattaccgtacattaccg

SEQ ID NO: 241 - DNA, 20 bp, Artificial Sequence
  Description of Artificial Sequence: Synthetic oligonucleotide
taccaatctctaccaatctc

SEQ ID NO: 242 - DNA, 20 bp, Artificial Sequence
  Description of Artificial Sequence: Synthetic oligonucleotide
taccggagagtaccggagag

SEQ ID NO: 243 - DNA, 20 bp, Artificial Sequence
  Description of Artificial Sequence: Synthetic oligonucleotide
taccggcttctaccggcttc

SEQ ID NO: 244 - DNA, 20 bp, Artificial Sequence
  Description of Artificial Sequence: Synthetic oligonucleotide
tacctacatgtacctacatg

SEQ ID NO: 245 - DNA, 20 bp, Artificial Sequence
  Description of Artificial Sequence: Synthetic oligonucleotide
tacgattacgtacgattacg

SEQ ID NO: 246 - DNA, 20 bp, Artificial Sequence
  Description of Artificial Sequence: Synthetic oligonucleotide
tacgcagaggtacgcagagg

SEQ ID NO: 247 - DNA, 20 bp, Artificial Sequence
  Description of Artificial Sequence: Synthetic oligonucleotide
tactcaacgatactcaacga

SEQ ID NO: 248 - DNA, 20 bp, Artificial Sequence
  Description of Artificial Sequence: Synthetic oligonucleotide
tagaccaacctagaccaacc

SEQ ID NO: 249 - DNA, 20 bp, Artificial Sequence
  Description of Artificial Sequence: Synthetic oligonucleotide
tagacctccgtagacctccg

SEQ ID NO: 250 - DNA, 20 bp, Artificial Sequence
  Description of Artificial Sequence: Synthetic oligonucleotide
tagcagttgatagcagttga

SEQ ID NO: 251 - DNA, 20 bp, Artificial Sequence
  Description of Artificial Sequence: Synthetic oligonucleotide
tagcgcaagctagcgcaagc

SEQ ID NO: 252 - DNA, 20 bp, Artificial Sequence
  Description of Artificial Sequence: Synthetic oligonucleotide
tagctatacctagctatacc

SEQ ID NO: 253 - DNA, 20 bp, Artificial Sequence
  Description of Artificial Sequence: Synthetic oligonucleotide
tagcttgcgctagcttgcgc

SEQ ID NO: 254 - DNA, 20 bp, Artificial Sequence
  Description of Artificial Sequence: Synthetic oligonucleotide
taggaatccataggaatcca

SEQ ID NO: 255 - DNA, 20 bp, Artificial Sequence
  Description of Artificial Sequence: Synthetic oligonucleotide
taggccgttctaggccgttc

SEQ ID NO: 256 - DNA, 20 bp, Artificial Sequence
  Description of Artificial Sequence: Synthetic oligonucleotide
taggtcactataggtcacta

SEQ ID NO: 257 - DNA, 20 bp, Artificial Sequence
  Description of Artificial Sequence: Synthetic oligonucleotide
tagtcgcgtctagtcgcgtc

SEQ ID NO: 258 - DNA, 20 bp, Artificial Sequence
  Description of Artificial Sequence: Synthetic oligonucleotide
tatacggctatatacggcta

SEQ ID NO: 259 - DNA, 20 bp, Artificial Sequence
  Description of Artificial Sequence: Synthetic oligonucleotide
tatcgcggcatatcgcggca

SEQ ID NO: 260 - DNA, 20 bp, Artificial Sequence
  Description of Artificial Sequence: Synthetic oligonucleotide
tatggagcaatatggagcaa

SEQ ID NO: 261 - DNA, 20 bp, Artificial Sequence
  Description of Artificial Sequence: Synthetic oligonucleotide
tatggcgtggtatggcgtgg

SEQ ID NO: 262 - DNA, 20 bp, Artificial Sequence
  Description of Artificial Sequence: Synthetic oligonucleotide
tatgttcaggtatgttcagg

SEQ ID NO: 263 - DNA, 20 bp, Artificial Sequence
  Description of Artificial Sequence: Synthetic oligonucleotide
tattcctgtctattcctgtc

SEQ ID NO: 264 - DNA, 20 bp, Artificial Sequence
  Description of Artificial Sequence: Synthetic oligonucleotide
tcaagagatctcaagagatc

SEQ ID NO: 265 - DNA, 20 bp, Artificial Sequence
  Description of Artificial Sequence: Synthetic oligonucleotide
tcactaccaatcactaccaa

SEQ ID NO: 266 - DNA, 20 bp, Artificial Sequence
  Description of Artificial Sequence: Synthetic oligonucleotide
tcagtctgcgtcagtctgcg

SEQ ID NO: 267 - DNA, 20 bp, Artificial Sequence
  Description of Artificial Sequence: Synthetic oligonucleotide
tcagttaagctcagttaagc

SEQ ID NO: 268 - DNA, 20 bp, Artificial Sequence
  Description of Artificial Sequence: Synthetic oligonucleotide
tccagagtggtccagagtgg

SEQ ID NO: 269 - DNA, 20 bp, Artificial Sequence
  Description of Artificial Sequence: Synthetic oligonucleotide
tccagtcgtctccagtcgtc

SEQ ID NO: 270 - DNA, 20 bp, Artificial Sequence
  Description of Artificial Sequence: Synthetic oligonucleotide
tccgacgttgtccgacgttg

SEQ ID NO: 271 - DNA, 20 bp, Artificial Sequence
  Description of Artificial Sequence: Synthetic oligonucleotide
tcctaccgactcctaccgac

SEQ ID NO: 272 - DNA, 20 bp, Artificial Sequence
  Description of Artificial Sequence: Synthetic oligonucleotide
tccttcctcctccttcctcc

SEQ ID NO: 273 - DNA, 20 bp, Artificial Sequence
  Description of Artificial Sequence: Synthetic oligonucleotide
tcgagagccatcgagagcca

SEQ ID NO: 274 - DNA, 20 bp, Artificial Sequence
  Description of Artificial Sequence: Synthetic oligonucleotide
tcgcacagactcgcacagac

SEQ ID NO: 275 - DNA, 20 bp, Artificial Sequence
  Description of Artificial Sequence: Synthetic oligonucleotide
tcgccgttagtcgccgttag

SEQ ID NO: 276 - DNA, 20 bp, Artificial Sequence
  Description of Artificial Sequence: Synthetic oligonucleotide
tcggcacaactcggcacaac

SEQ ID NO: 277 - DNA, 20 bp, Artificial Sequence
  Description of Artificial Sequence: Synthetic oligonucleotide
tcggcagttgtcggcagttg

SEQ ID NO: 278 - DNA, 20 bp, Artificial Sequence
  Description of Artificial Sequence: Synthetic oligonucleotide
tcggtcacactcggtcacac

SEQ ID NO: 279 - DNA, 20 bp, Artificial Sequence
  Description of Artificial Sequence: Synthetic oligonucleotide
tcgtgctagctcgtgctagc

SEQ ID NO: 280 - DNA, 20 bp, Artificial Sequence
  Description of Artificial Sequence: Synthetic oligonucleotide
tctagcctaatctagcctaa

SEQ ID NO: 281 - DNA, 20 bp, Artificial Sequence
  Description of Artificial Sequence: Synthetic oligonucleotide
tctcactgcgtctcactgcg

SEQ ID NO: 282 - DNA, 20 bp, Artificial Sequence
  Description of Artificial Sequence: Synthetic oligonucleotide
tctccggcaatctccggcaa

SEQ ID NO: 283 - DNA, 20 bp, Artificial Sequence
  Description of Artificial Sequence: Synthetic oligonucleotide
tctcgctctctctcgctctc

SEQ ID NO: 284 - DNA, 20 bp, Artificial Sequence
  Description of Artificial Sequence: Synthetic oligonucleotide
tctgtcgcaatctgtcgcaa

SEQ ID NO: 285 - DNA, 20 bp, Artificial Sequence
  Description of Artificial Sequence: Synthetic oligonucleotide
tcttaacctctcttaacctc

SEQ ID NO: 286 - DNA, 20 bp, Artificial Sequence
  Description of Artificial Sequence: Synthetic oligonucleotide
tgacacatgatgacacatga

SEQ ID NO: 287 - DNA, 20 bp, Artificial Sequence
  Description of Artificial Sequence: Synthetic oligonucleotide
tgagagtgaatgagagtgaa

SEQ ID NO: 288 - DNA, 20 bp, Artificial Sequence
  Description of Artificial Sequence: Synthetic oligonucleotide
tgagtggctgtgagtggctg

SEQ ID NO: 289 - DNA, 20 bp, Artificial Sequence
  Description of Artificial Sequence: Synthetic oligonucleotide
tgattgaccatgattgacca

SEQ ID NO: 290 - DNA, 20 bp, Artificial Sequence
  Description of Artificial Sequence: Synthetic oligonucleotide
tgcagtcgcatgcagtcgca

SEQ ID NO: 291 - DNA, 20 bp, Artificial Sequence
  Description of Artificial Sequence: Synthetic oligonucleotide
tgccatgaggtgccatgagg

SEQ ID NO: 292 - DNA, 20 bp, Artificial Sequence
  Description of Artificial Sequence: Synthetic oligonucleotide
tgcctaacgctgcctaacgc

SEQ ID NO: 293 - DNA, 20 bp, Artificial Sequence
  Description of Artificial Sequence: Synthetic oligonucleotide
tgcctataactgcctataac

SEQ ID NO: 294 - DNA, 20 bp, Artificial Sequence
  Description of Artificial Sequence: Synthetic oligonucleotide
tgcgagagagtgcgagagag

SEQ ID NO: 295 - DNA, 20 bp, Artificial Sequence
  Description of Artificial Sequence: Synthetic oligonucleotide
tgcgcgatcatgcgcgatca

SEQ ID NO: 296 - DNA, 20 bp, Artificial Sequence
  Description of Artificial Sequence: Synthetic oligonucleotide
tgcggagtgatgcggagtga

SEQ ID NO: 297 - DNA, 20 bp, Artificial Sequence
  Description of Artificial Sequence: Synthetic oligonucleotide
tgcggattcctgcggattcc

SEQ ID NO: 298 - DNA, 20 bp, Artificial Sequence
  Description of Artificial Sequence: Synthetic oligonucleotide
tgcggctacatgcggctaca

SEQ ID NO: 299 - DNA, 20 bp, Artificial Sequence
  Description of Artificial Sequence: Synthetic oligonucleotide
tgcgtaacaatgcgtaacaa

SEQ ID NO: 300 - DNA, 20 bp, Artificial Sequence
  Description of Artificial Sequence: Synthetic oligonucleotide
tgcgtcctcatgcgtcctca

SEQ ID NO: 301 - DNA, 20 bp, Artificial Sequence
  Description of Artificial Sequence: Synthetic oligonucleotide
tgcgttcagctgcgttcagc

SEQ ID NO: 302 - DNA, 20 bp, Artificial Sequence
  Description of Artificial Sequence: Synthetic oligonucleotide
tgcttcagcgtgcttcagcg

SEQ ID NO: 303 - DNA, 20 bp, Artificial Sequence
  Description of Artificial Sequence: Synthetic oligonucleotide
tgcttgcctctgcttgcctc

SEQ ID NO: 304 - DNA, 20 bp, Artificial Sequence
  Description of Artificial Sequence: Synthetic oligonucleotide
tggaactggctggaactggc

SEQ ID NO: 305 - DNA, 20 bp, Artificial Sequence
  Description of Artificial Sequence: Synthetic oligonucleotide
tgtattggagtgtattggag

SEQ ID NO: 306 - DNA, 20 bp, Artificial Sequence
  Description of Artificial Sequence: Synthetic oligonucleotide
tgtggaacggtgtggaacgg

SEQ ID NO: 307 - DNA, 20 bp, Artificial Sequence
  Description of Artificial Sequence: Synthetic oligonucleotide
tgtggagtcgtgtggagtcg

SEQ ID NO: 308 - DNA, 20 bp, Artificial Sequence
  Description of Artificial Sequence: Synthetic oligonucleotide
tgtgtggccatgtgtggcca

SEQ ID NO: 309 - DNA, 20 bp, Artificial Sequence
  Description of Artificial Sequence: Synthetic oligonucleotide
tgttaagaggtgttaagagg

SEQ ID NO: 310 - DNA, 20 bp, Artificial Sequence
  Description of Artificial Sequence: Synthetic oligonucleotide
tgttactcactgttactcac

SEQ ID NO: 311 - DNA, 20 bp, Artificial Sequence
  Description of Artificial Sequence: Synthetic oligonucleotide
tgttcgcagctgttcgcagc

SEQ ID NO: 312 - DNA, 20 bp, Artificial Sequence
  Description of Artificial Sequence: Synthetic oligonucleotide
tgttggcatatgttggcata

SEQ ID NO: 313 - DNA, 20 bp, Artificial Sequence
  Description of Artificial Sequence: Synthetic oligonucleotide
ttaagtgcagttaagtgcag

SEQ ID NO: 314 - DNA, 20 bp, Artificial Sequence
  Description of Artificial Sequence: Synthetic oligonucleotide
ttagagatccttagagatcc

SEQ ID NO: 315 - DNA, 20 bp, Artificial Sequence
  Description of Artificial Sequence: Synthetic oligonucleotide
ttaggtcagattaggtcaga

SEQ ID NO: 316 - DNA, 20 bp, Artificial Sequence
  Description of Artificial Sequence: Synthetic oligonucleotide
ttatctcctgttatctcctg

SEQ ID NO: 317 - DNA, 20 bp, Artificial Sequence
  Description of Artificial Sequence: Synthetic oligonucleotide
ttcagtgtcgttcagtgtcg

SEQ ID NO: 318 - DNA, 20 bp, Artificial Sequence
  Description of Artificial Sequence: Synthetic oligonucleotide
ttccaagaagttccaagaag

SEQ ID NO: 319 - DNA, 20 bp, Artificial Sequence
  Description of Artificial Sequence: Synthetic oligonucleotide
ttccaccgcattccaccgca

SEQ ID NO: 320 - DNA, 20 bp, Artificial Sequence
  Description of Artificial Sequence: Synthetic oligonucleotide
ttccactatcttccactatc

SEQ ID NO: 321 - DNA, 20 bp, Artificial Sequence
  Description of Artificial Sequence: Synthetic oligonucleotide
ttccacttgattccacttga

SEQ ID NO: 322 - DNA, 20 bp, Artificial Sequence
  Description of Artificial Sequence: Synthetic oligonucleotide
ttccgagagcttccgagagc

SEQ ID NO: 323 - DNA, 20 bp, Artificial Sequence
  Description of Artificial Sequence: Synthetic oligonucleotide
ttcctgagccttcctgagcc

SEQ ID NO: 324 - DNA, 20 bp, Artificial Sequence
  Description of Artificial Sequence: Synthetic oligonucleotide
ttcgagtcgcttcgagtcgc

SEQ ID NO: 325 - DNA, 20 bp, Artificial Sequence
  Description of Artificial Sequence: Synthetic oligonucleotide
ttcgtgccagttcgtgccag

SEQ ID NO: 326 - DNA, 20 bp, Artificial Sequence
  Description of Artificial Sequence: Synthetic oligonucleotide
ttctacaccattctacacca

SEQ ID NO: 327 - DNA, 20 bp, Artificial Sequence
  Description of Artificial Sequence: Synthetic oligonucleotide
ttctcgctccttctcgctcc

SEQ ID NO: 328 - DNA, 20 bp, Artificial Sequence
  Description of Artificial Sequence: Synthetic oligonucleotide
ttctggccacttctggccac

SEQ ID NO: 329 - DNA, 20 bp, Artificial Sequence
  Description of Artificial Sequence: Synthetic oligonucleotide
ttgaatggtgttgaatggtg

SEQ ID NO: 330 - DNA, 20 bp, Artificial Sequence
  Description of Artificial Sequence: Synthetic oligonucleotide
ttgagccgacttgagccgac

SEQ ID NO: 331 - DNA, 20 bp, Artificial Sequence
  Description of Artificial Sequence: Synthetic oligonucleotide
ttgcgccaagttgcgccaag

SEQ ID NO: 332 - DNA, 20 bp, Artificial Sequence
  Description of Artificial Sequence: Synthetic oligonucleotide
ttgctcttagttgctcttag

SEQ ID NO: 333 - DNA, 20 bp, Artificial Sequence
  Description of Artificial Sequence: Synthetic oligonucleotide
ttggcaaggcttggcaaggc

SEQ ID NO: 334 - DNA, 20 bp, Artificial Sequence
  Description of Artificial Sequence: Synthetic oligonucleotide
ttggctcacgttggctcacg

SEQ ID NO: 335 - DNA, 20 bp, Artificial Sequence
  Description of Artificial Sequence: Synthetic oligonucleotide
ttggcttccattggcttcca

SEQ ID NO: 336 - DNA, 20 bp, Artificial Sequence
  Description of Artificial Sequence: Synthetic oligonucleotide
ttgtggatacttgtggatac

SEQ ID NO: 337 - DNA, 20 bp, Artificial Sequence
  Description of Artificial Sequence: Synthetic oligonucleotide
aacacggatgaacacggatg

SEQ ID NO: 338 - DNA, 20 bp, Artificial Sequence
  Description of Artificial Sequence: Synthetic oligonucleotide
aacagaccggaacagaccgg

SEQ ID NO: 339 - DNA, 20 bp, Artificial Sequence
  Description of Artificial Sequence: Synthetic oligonucleotide
aacagtgatcaacagtgatc

SEQ ID NO: 340 - DNA, 20 bp, Artificial Sequence
  Description of Artificial Sequence: Synthetic oligonucleotide
aaccatcttgaaccatcttg

SEQ ID NO: 341 - DNA, 20 bp, Artificial Sequence
  Description of Artificial Sequence: Synthetic oligonucleotide
aacggtgacgaacggtgacg

SEQ ID NO: 342 - DNA, 20 bp, Artificial Sequence
  Description of Artificial Sequence: Synthetic oligonucleotide
aactacgcggaactacgcgg

SEQ ID NO: 343 - DNA, 20 bp, Artificial Sequence
  Description of Artificial Sequence: Synthetic oligonucleotide
aactaggcttaactaggctt

SEQ ID NO: 344 - DNA, 20 bp, Artificial Sequence
  Description of Artificial Sequence: Synthetic oligonucleotide
aactggcgtgaactggcgtg

SEQ ID NO: 345 - DNA, 20 bp, Artificial Sequence
  Description of Artificial Sequence: Synthetic oligonucleotide
aagacaggataagacaggat

SEQ ID NO: 346 - DNA, 20 bp, Artificial Sequence
  Description of Artificial Sequence: Synthetic oligonucleotide
aagagccagtaagagccagt

SEQ ID NO: 347 - DNA, 20 bp, Artificial Sequence
  Description of Artificial Sequence: Synthetic oligonucleotide
aagagtatcgaagagtatcg

SEQ ID NO: 348 - DNA, 20 bp, Artificial Sequence
  Description of Artificial Sequence: Synthetic oligonucleotide
aaggaacactaaggaacact

SEQ ID NO: 349 - DNA, 20 bp, Artificial Sequence
  Description of Artificial Sequence: Synthetic oligonucleotide
aagtcgcaggaagtcgcagg

SEQ ID NO: 350 - DNA, 20 bp, Artificial Sequence
  Description of Artificial Sequence: Synthetic oligonucleotide
aatcacagtcaatcacagtc

SEQ ID NO: 351 - DNA, 20 bp, Artificial Sequence
  Description of Artificial Sequence: Synthetic oligonucleotide
aatcgccattaatcgccatt

SEQ ID NO: 352 - DNA, 20 bp, Artificial Sequence
  Description of Artificial Sequence: Synthetic oligonucleotide
aattgcggccaattgcggcc

SEQ ID NO: 353 - DNA, 20 bp, Artificial Sequence
  Description of Artificial Sequence: Synthetic oligonucleotide
acaactcgcgacaactcgcg

SEQ ID NO: 354 - DNA, 20 bp, Artificial Sequence
  Description of Artificial Sequence: Synthetic oligonucleotide
acaagctgcgacaagctgcg

SEQ ID NO: 355 - DNA, 20 bp, Artificial Sequence
  Description of Artificial Sequence: Synthetic oligonucleotide
acaccaattcacaccaattc

SEQ ID NO: 356 - DNA, 20 bp, Artificial Sequence
  Description of Artificial Sequence: Synthetic oligonucleotide
acacgaaggtacacgaaggt

SEQ ID NO: 357 - DNA, 20 bp, Artificial Sequence
  Description of Artificial Sequence: Synthetic oligonucleotide
acagaatgtgacagaatgtg

SEQ ID NO: 358 - DNA, 20 bp, Artificial Sequence
  Description of Artificial Sequence: Synthetic oligonucleotide
acatagtggtacatagtggt

SEQ ID NO: 359 - DNA, 20 bp, Artificial Sequence
  Description of Artificial Sequence: Synthetic oligonucleotide
accaccacgtaccaccacgt

SEQ ID NO: 360 - DNA, 20 bp, Artificial Sequence
  Description of Artificial Sequence: Synthetic oligonucleotide
accgacagctaccgacagct

SEQ ID NO: 361 - DNA, 20 bp, Artificial Sequence
  Description of Artificial Sequence: Synthetic oligonucleotide
accggctagtaccggctagt

SEQ ID NO: 362 - DNA, 20 bp, Artificial Sequence
  Description of Artificial Sequence: Synthetic oligonucleotide
accgtagattaccgtagatt

SEQ ID NO: 363 - DNA, 20 bp, Artificial Sequence
  Description of Artificial Sequence: Synthetic oligonucleotide
accgtgacttaccgtgactt

SEQ ID NO: 364 - DNA, 20 bp, Artificial Sequence
  Description of Artificial Sequence: Synthetic oligonucleotide
acctcacaacacctcacaac

SEQ ID NO: 365 - DNA, 20 bp, Artificial Sequence
  Description of Artificial Sequence: Synthetic oligonucleotide
accttgtcctaccttgtcct

SEQ ID NO: 366 - DNA, 20 bp, Artificial Sequence
  Description of Artificial Sequence: Synthetic oligonucleotide
acgaagcaggacgaagcagg

SEQ ID NO: 367 - DNA, 20 bp, Artificial Sequence
  Description of Artificial Sequence: Synthetic oligonucleotide
acgactggacacgactggac

SEQ ID NO: 368 - DNA, 20 bp, Artificial Sequence
  Description of Artificial Sequence: Synthetic oligonucleotide
acgagagcagacgagagcag

SEQ ID NO: 369 - DNA, 20 bp, Artificial Sequence
  Description of Artificial Sequence: Synthetic oligonucleotide
acgcctgttgacgcctgttg

SEQ ID NO: 370 - DNA, 20 bp, Artificial Sequence
  Description of Artificial Sequence: Synthetic oligonucleotide
acgcgacttcacgcgacttc

SEQ ID NO: 371 - DNA, 20 bp, Artificial Sequence
  Description of Artificial Sequence: Synthetic oligonucleotide
acggattgatacggattgat

SEQ ID NO: 372 - DNA, 20 bp, Artificial Sequence
  Description of Artificial Sequence: Synthetic oligonucleotide
acggctcatgacggctcatg

SEQ ID NO: 373 - DNA, 20 bp, Artificial Sequence
  Description of Artificial Sequence: Synthetic oligonucleotide
acggtaagatacggtaagat

SEQ ID NO: 374 - DNA, 20 bp, Artificial Sequence
  Description of Artificial Sequence: Synthetic oligonucleotide
acggtagcacacggtagcac

SEQ ID NO: 375 - DNA, 20 bp, Artificial Sequence
  Description of Artificial Sequence: Synthetic oligonucleotide
acggtgttcgacggtgttcg

SEQ ID NO: 376 - DNA, 20 bp, Artificial Sequence
  Description of Artificial Sequence: Synthetic oligonucleotide
acgtcgatggacgtcgatgg

SEQ ID NO: 377 - DNA, 20 bp, Artificial Sequence
  Description of Artificial Sequence: Synthetic oligonucleotide
acgtgcagacacgtgcagac

SEQ ID NO: 378 - DNA, 20 bp, Artificial Sequence
  Description of Artificial Sequence: Synthetic oligonucleotide
acgttccagcacgttccagc

SEQ ID NO: 379 - DNA, 20 bp, Artificial Sequence
  Description of Artificial Sequence: Synthetic oligonucleotide
actagcttgtactagcttgt

SEQ ID NO: 380 - DNA, 20 bp, Artificial Sequence
  Description of Artificial Sequence: Synthetic oligonucleotide
actaggacgcactaggacgc

SEQ ID NO: 381 - DNA, 20 bp, Artificial Sequence
  Description of Artificial Sequence: Synthetic oligonucleotide
actcacctggactcacctgg

SEQ ID NO: 382 - DNA, 20 bp, Artificial Sequence
  Description of Artificial Sequence: Synthetic oligonucleotide
actcatatcgactcatatcg

SEQ ID NO: 383 - DNA, 20 bp, Artificial Sequence
  Description of Artificial Sequence: Synthetic oligonucleotide
actgaccgtgactgaccgtg

SEQ ID NO: 384 - DNA, 20 bp, Artificial Sequence
  Description of Artificial Sequence: Synthetic oligonucleotide
acttctaaccacttctaacc

SEQ ID NO: 385 - DNA, 20 bp, Artificial Sequence
  Description of Artificial Sequence: Synthetic oligonucleotide
acttggcgctacttggcgct

SEQ ID NO: 386 - DNA, 20 bp, Artificial Sequence
  Description of Artificial Sequence: Synthetic oligonucleotide
agaacgctccagaacgctcc

SEQ ID NO: 387 - DNA, 20 bp, Artificial Sequence
  Description of Artificial Sequence: Synthetic oligonucleotide
agaacttaggagaacttagg

SEQ ID NO: 388 - DNA, 20 bp, Artificial Sequence
  Description of Artificial Sequence: Synthetic oligonucleotide
agaagcgcatagaagcgcat

SEQ ID NO: 389 - DNA, 20 bp, Artificial Sequence
  Description of Artificial Sequence: Synthetic oligonucleotide
agacaatagcagacaatagc

SEQ ID NO: 390 - DNA, 20 bp, Artificial Sequence
  Description of Artificial Sequence: Synthetic oligonucleotide
agaccgagacagaccgagac

SEQ ID NO: 391 - DNA, 20 bp, Artificial Sequence
  Description of Artificial Sequence: Synthetic oligonucleotide
agacgctgtcagacgctgtc

SEQ ID NO: 392 - DNA, 20 bp, Artificial Sequence
  Description of Artificial Sequence: Synthetic oligonucleotide
agacgtagcgagacgtagcg

SEQ ID NO: 393 - DNA, 20 bp, Artificial Sequence
  Description of Artificial Sequence: Synthetic oligonucleotide
agagagctctagagagctct

SEQ ID NO: 394 - DNA, 20 bp, Artificial Sequence
  Description of Artificial Sequence: Synthetic oligonucleotide
agaggccactagaggccact

SEQ ID NO: 395 - DNA, 20 bp, Artificial Sequence
  Description of Artificial Sequence: Synthetic oligonucleotide
agattgccgcagattgccgc

SEQ ID NO: 396 - DNA, 20 bp, Artificial Sequence
  Description of Artificial Sequence: Synthetic oligonucleotide
agcacgatgcagcacgatgc

SEQ ID NO: 397 - DNA, 20 bp, Artificial Sequence
  Description of Artificial Sequence: Synthetic oligonucleotide
agcagagaatagcagagaat

SEQ ID NO: 398 - DNA, 20 bp, Artificial Sequence
  Description of Artificial Sequence: Synthetic oligonucleotide
agccacaaggagccacaagg

SEQ ID NO: 399 - DNA, 20 bp, Artificial Sequence
  Description of Artificial Sequence: Synthetic oligonucleotide
agccaggaagagccaggaag

SEQ ID NO: 400 - DNA, 20 bp, Artificial Sequence
  Description of Artificial Sequence: Synthetic oligonucleotide
agctctggagagctctggag

SEQ ID NO: 401 - DNA, 20 bp, Artificial Sequence
  Description of Artificial Sequence: Synthetic oligonucleotide
agcttggcagagcttggcag

SEQ ID NO: 402 - DNA, 20 bp, Artificial Sequence
  Description of Artificial Sequence: Synthetic oligonucleotide
aggaataacgaggaataacg

SEQ ID NO: 403 - DNA, 20 bp, Artificial Sequence
  Description of Artificial Sequence: Synthetic oligonucleotide
aggaattgacaggaattgac

SEQ ID NO: 404 - DNA, 20 bp, Artificial Sequence
  Description of Artificial Sequence: Synthetic oligonucleotide
aggaggaattaggaggaatt

SEQ ID NO: 405 - DNA, 20 bp, Artificial Sequence
  Description of Artificial Sequence: Synthetic oligonucleotide
aggataggccaggataggcc

SEQ ID NO: 406 - DNA, 20 bp, Artificial Sequence
  Description of Artificial Sequence: Synthetic oligonucleotide
aggtggccttaggtggcctt

SEQ ID NO: 407 - DNA, 20 bp, Artificial Sequence
  Description of Artificial Sequence: Synthetic oligonucleotide
aggtgttgcgaggtgttgcg

SEQ ID NO: 408 - DNA, 20 bp, Artificial Sequence
  Description of Artificial Sequence: Synthetic oligonucleotide
aggttaggtgaggttaggtg

SEQ ID NO: 409 - DNA, 20 bp, Artificial Sequence
  Description of Artificial Sequence: Synthetic oligonucleotide
agtccgtcctagtccgtcct

SEQ ID NO: 410 - DNA, 20 bp, Artificial Sequence
  Description of Artificial Sequence: Synthetic oligonucleotide
agtcgatccgagtcgatccg

SEQ ID NO: 411 - DNA, 20 bp, Artificial Sequence
  Description of Artificial Sequence: Synthetic oligonucleotide
agtcgctgctagtcgctgct

SEQ ID NO: 412 - DNA, 20 bp, Artificial Sequence
  Description of Artificial Sequence: Synthetic oligonucleotide
agtcgtcctcagtcgtcctc

SEQ ID NO: 413 - DNA, 20 bp, Artificial Sequence
  Description of Artificial Sequence: Synthetic oligonucleotide
agtgttccgtagtgttccgt

SEQ ID NO: 414 - DNA, 20 bp, Artificial Sequence
  Description of Artificial Sequence: Synthetic oligonucleotide
agttgctcatagttgctcat

SEQ ID NO: 415 - DNA, 20 bp, Artificial Sequence
  Description of Artificial Sequence: Synthetic oligonucleotide
ataacgtgagataacgtgag

SEQ ID NO: 416 - DNA, 20 bp, Artificial Sequence
  Description of Artificial Sequence: Synthetic oligonucleotide
atacgcaggcatacgcaggc

SEQ ID NO: 417 - DNA, 20 bp, Artificial Sequence
  Description of Artificial Sequence: Synthetic oligonucleotide
atactgatgcatactgatgc

SEQ ID NO: 418 - DNA, 20 bp, Artificial Sequence
  Description of Artificial Sequence: Synthetic oligonucleotide
atagttcgtcatagttcgtc

SEQ ID NO: 419 - DNA, 20 bp, Artificial Sequence
  Description of Artificial Sequence: Synthetic oligonucleotide
atatcttcgcatatcttcgc

SEQ ID NO: 420 - DNA, 20 bp, Artificial Sequence
  Description of Artificial Sequence: Synthetic oligonucleotide
atatgccttcatatgccttc

SEQ ID NO: 421 - DNA, 20 bp, Artificial Sequence
  Description of Artificial Sequence: Synthetic oligonucleotide
atcagatcacatcagatcac

SEQ ID NO: 422 - DNA, 20 bp, Artificial Sequence
  Description of Artificial Sequence: Synthetic oligonucleotide
atccaatctgatccaatctg

SEQ ID NO: 423 - DNA, 20 bp, Artificial Sequence
  Description of Artificial Sequence: Synthetic oligonucleotide
atccacagcgatccacagcg

SEQ ID NO: 424 - DNA, 20 bp, Artificial Sequence
  Description of Artificial Sequence: Synthetic oligonucleotide
atccggaacgatccggaacg

SEQ ID NO: 425 - DNA, 20 bp, Artificial Sequence
  Description of Artificial Sequence: Synthetic oligonucleotide
atcggcttccatcggcttcc

SEQ ID NO: 426 - DNA, 20 bp, Artificial Sequence
  Description of Artificial Sequence: Synthetic oligonucleotide
atcgtcggagatcgtcggag

SEQ ID NO: 427 - DNA, 20 bp, Artificial Sequence
  Description of Artificial Sequence: Synthetic oligonucleotide
atctctcacgatctctcacg

SEQ ID NO: 428 - DNA, 20 bp, Artificial Sequence
  Description of Artificial Sequence: Synthetic oligonucleotide
atgcacctgcatgcacctgc

SEQ ID NO: 429 - DNA, 20 bp, Artificial Sequence
  Description of Artificial Sequence: Synthetic oligonucleotide
atgcagtcgcatgcagtcgc

SEQ ID NO: 430 - DNA, 20 bp, Artificial Sequence
  Description of Artificial Sequence: Synthetic oligonucleotide
atgccgtaggatgccgtagg

SEQ ID NO: 431 - DNA, 20 bp, Artificial Sequence
  Description of Artificial Sequence: Synthetic oligonucleotide
atgcgcgatcatgcgcgatc

SEQ ID NO: 432 - DNA, 20 bp, Artificial Sequence
  Description of Artificial Sequence: Synthetic oligonucleotide
atgtggtgatatgtggtgat

SEQ ID NO: 433 - DNA, 20 bp, Artificial Sequence
  Description of Artificial Sequence: Synthetic oligonucleotide
attacgagccattacgagcc

SEQ ID NO: 434 - DNA, 20 bp, Artificial Sequence
  Description of Artificial Sequence: Synthetic oligonucleotide
attccacggcattccacggc

SEQ ID NO: 435 - DNA, 20 bp, Artificial Sequence
  Description of Artificial Sequence: Synthetic oligonucleotide
attcggcgtcattcggcgtc

SEQ ID NO: 436 - DNA, 20 bp, Artificial Sequence
  Description of Artificial Sequence: Synthetic oligonucleotide
attggaagccattggaagcc

SEQ ID NO: 437 - DNA, 20 bp, Artificial Sequence
  Description of Artificial Sequence: Synthetic oligonucleotide
attgtcggccattgtcggcc

SEQ ID NO: 438 - DNA, 20 bp, Artificial Sequence
  Description of Artificial Sequence: Synthetic oligonucleotide
caaccgcttgcaaccgcttg

SEQ ID NO: 439 - DNA, 20 bp, Artificial Sequence
  Description of Artificial Sequence: Synthetic oligonucleotide
caactggtggcaactggtgg

SEQ ID NO: 440 - DNA, 20 bp, Artificial Sequence
  Description of Artificial Sequence: Synthetic oligonucleotide
caagatggtgcaagatggtg

SEQ ID NO: 441 - DNA, 20 bp, Artificial Sequence
  Description of Artificial Sequence: Synthetic oligonucleotide
caagattcgacaagattcga

SEQ ID NO: 442 - DNA, 20 bp, Artificial Sequence
  Description of Artificial Sequence: Synthetic oligonucleotide
caagcacgagcaagcacgag

SEQ ID NO: 443 - DNA, 20 bp, Artificial Sequence
  Description of Artificial Sequence: Synthetic oligonucleotide
caagcctgtgcaagcctgtg

SEQ ID NO: 444 - DNA, 20 bp, Artificial Sequence
  Description of Artificial Sequence: Synthetic oligonucleotide
caagctcacgcaagctcacg

SEQ ID NO: 445 - DNA, 20 bp, Artificial Sequence
  Description of Artificial Sequence: Synthetic oligonucleotide
caaggttgcgcaaggttgcg

SEQ ID NO: 446 - DNA, 20 bp, Artificial Sequence
  Description of Artificial Sequence: Synthetic oligonucleotide
caagtcgacgcaagtcgacg

SEQ ID NO: 447 - DNA, 20 bp, Artificial Sequence
  Description of Artificial Sequence: Synthetic oligonucleotide
caccacgaagcaccacgaag

SEQ ID NO: 448 - DNA, 20 bp, Artificial Sequence
  Description of Artificial Sequence: Synthetic oligonucleotide
caccgatattcaccgatatt

SEQ ID NO: 449 - DNA, 20 bp, Artificial Sequence
  Description of Artificial Sequence: Synthetic oligonucleotide
caccgtcgaacaccgtcgaa

SEQ ID NO: 450 - DNA, 20 bp, Artificial Sequence
  Description of Artificial Sequence: Synthetic oligonucleotide
caccgtgacacaccgtgaca

SEQ ID NO: 451 - DNA, 20 bp, Artificial Sequence
  Description of Artificial Sequence: Synthetic oligonucleotide
cacctgctgacacctgctga

SEQ ID NO: 452 - DNA, 20 bp, Artificial Sequence
  Description of Artificial Sequence: Synthetic oligonucleotide
cacgcacatacacgcacata

SEQ ID NO: 453 - DNA, 20 bp, Artificial Sequence
  Description of Artificial Sequence: Synthetic oligonucleotide
cacgctaaggcacgctaagg

SEQ ID NO: 454 - DNA, 20 bp, Artificial Sequence
  Description of Artificial Sequence: Synthetic oligonucleotide
cacgtaatctcacgtaatct

SEQ ID NO: 455 - DNA, 20 bp, Artificial Sequence
  Description of Artificial Sequence: Synthetic oligonucleotide
cacgtggagtcacgtggagt

SEQ ID NO: 456 - DNA, 20 bp, Artificial Sequence
  Description of Artificial Sequence: Synthetic oligonucleotide
cactcgagagcactcgagag

SEQ ID NO: 457 - DNA, 20 bp, Artificial Sequence
  Description of Artificial Sequence: Synthetic oligonucleotide
cactctctgacactctctga

SEQ ID NO: 458 - DNA, 20 bp, Artificial Sequence
  Description of Artificial Sequence: Synthetic oligonucleotide
cactctggctcactctggct

SEQ ID NO: 459 - DNA, 20 bp, Artificial Sequence
  Description of Artificial Sequence: Synthetic oligonucleotide
cactgccatgcactgccatg

SEQ ID NO: 460 - DNA, 20 bp, Artificial Sequence
  Description of Artificial Sequence: Synthetic oligonucleotide
cacttgaactcacttgaact

SEQ ID NO: 461 - DNA, 20 bp, Artificial Sequence
  Description of Artificial Sequence: Synthetic oligonucleotide
cagacctgagcagacctgag

SEQ ID NO: 462 - DNA, 20 bp, Artificial Sequence
  Description of Artificial Sequence: Synthetic oligonucleotide
cagcgagcatcagcgagcat

SEQ ID NO: 463 - DNA, 20 bp, Artificial Sequence
  Description of Artificial Sequence: Synthetic oligonucleotide
caggaagaggcaggaagagg

SEQ ID NO: 464 - DNA, 20 bp, Artificial Sequence
  Description of Artificial Sequence: Synthetic oligonucleotide
cagtctcatacagtctcata

SEQ ID NO: 465 - DNA, 20 bp, Artificial Sequence
  Description of Artificial Sequence: Synthetic oligonucleotide
cagttatcgacagttatcga

SEQ ID NO: 466 - DNA, 20 bp, Artificial Sequence
  Description of Artificial Sequence: Synthetic oligonucleotide
catacacgcgcatacacgcg

SEQ ID NO: 467 - DNA, 20 bp, Artificial Sequence
  Description of Artificial Sequence: Synthetic oligonucleotide
cataccgacgcataccgacg

SEQ ID NO: 468 - DNA, 20 bp, Artificial Sequence
  Description of Artificial Sequence: Synthetic oligonucleotide
catcaatggtcatcaatggt

SEQ ID NO: 469 - DNA, 20 bp, Artificial Sequence
  Description of Artificial Sequence: Synthetic oligonucleotide
catgacaccgcatgacaccg

SEQ ID NO: 470 - DNA, 20 bp, Artificial Sequence
  Description of Artificial Sequence: Synthetic oligonucleotide
catggttcggcatggttcgg

SEQ ID NO: 471 - DNA, 20 bp, Artificial Sequence
  Description of Artificial Sequence: Synthetic oligonucleotide
cattggagcgcattggagcg

SEQ ID NO: 472 - DNA, 20 bp, Artificial Sequence
  Description of Artificial Sequence: Synthetic oligonucleotide
ccaacgagagccaacgagag

SEQ ID NO: 473 - DNA, 20 bp, Artificial Sequence
  Description of Artificial Sequence: Synthetic oligonucleotide
ccaagaccagccaagaccag

SEQ ID NO: 474 - DNA, 20 bp, Artificial Sequence
  Description of Artificial Sequence: Synthetic oligonucleotide
ccaatcacggccaatcacgg

SEQ ID NO: 475 - DNA, 20 bp, Artificial Sequence
  Description of Artificial Sequence: Synthetic oligonucleotide
ccaccgttgtccaccgttgt

SEQ ID NO: 476 - DNA, 20 bp, Artificial Sequence
  Description of Artificial Sequence: Synthetic oligonucleotide
ccagatcggaccagatcgga

SEQ ID NO: 477 - DNA, 20 bp, Artificial Sequence
  Description of Artificial Sequence: Synthetic oligonucleotide
ccgaagtcagccgaagtcag

SEQ ID NO: 478 - DNA, 20 bp, Artificial Sequence
  Description of Artificial Sequence: Synthetic oligonucleotide
ccgctgaagtccgctgaagt

SEQ ID NO: 479 - DNA, 20 bp, Artificial Sequence
  Description of Artificial Sequence: Synthetic oligonucleotide
ccggaccataccggaccata

SEQ ID NO: 480 - DNA, 20 bp, Artificial Sequence
  Description of Artificial Sequence: Synthetic oligonucleotide
ccgttctaggccgttctagg

SEQ ID NO: 481 - DNA, 20 bp, Artificial Sequence
  Description of Artificial Sequence: Synthetic oligonucleotide
cctaatgcggcctaatgcgg

SEQ ID NO: 482 - DNA, 20 bp, Artificial Sequence
  Description of Artificial Sequence: Synthetic oligonucleotide
cctatgacgacctatgacga

SEQ ID NO: 483 - DNA, 20 bp, Artificial Sequence
  Description of Artificial Sequence: Synthetic oligonucleotide
cctcaccagtcctcaccagt

SEQ ID NO: 484 - DNA, 20 bp, Artificial Sequence
  Description of Artificial Sequence: Synthetic oligonucleotide
cctgaagacgcctgaagacg

SEQ ID NO: 485 - DNA, 20 bp, Artificial Sequence
  Description of Artificial Sequence: Synthetic oligonucleotide
cctgactcctcctgactcct

SEQ ID NO: 486 - DNA, 20 bp, Artificial Sequence
  Description of Artificial Sequence: Synthetic oligonucleotide
cgaagagtggcgaagagtgg

SEQ ID NO: 487 - DNA, 20 bp, Artificial Sequence
  Description of Artificial Sequence: Synthetic oligonucleotide
cgaaggtggtcgaaggtggt

SEQ ID NO: 488 - DNA, 20 bp, Artificial Sequence
  Description of Artificial Sequence: Synthetic oligonucleotide
cgactagcagcgactagcag

SEQ ID NO: 489 - DNA, 20 bp, Artificial Sequence
  Description of Artificial Sequence: Synthetic oligonucleotide
cgactcgagacgactcgaga

SEQ ID NO: 490 - DNA, 20 bp, Artificial Sequence
  Description of Artificial Sequence: Synthetic oligonucleotide
cgacttacaacgacttacaa

SEQ ID NO: 491 - DNA, 20 bp, Artificial Sequence
  Description of Artificial Sequence: Synthetic oligonucleotide
cgaggattaacgaggattaa

SEQ ID NO: 492 - DNA, 20 bp, Artificial Sequence
  Description of Artificial Sequence: Synthetic oligonucleotide
cgaggcatgtcgaggcatgt

SEQ ID NO: 493 - DNA, 20 bp, Artificial Sequence
  Description of Artificial Sequence: Synthetic oligonucleotide
cgagtctgctcgagtctgct

SEQ ID NO: 494 - DNA, 20 bp, Artificial Sequence
  Description of Artificial Sequence: Synthetic oligonucleotide
cgagtgagcacgagtgagca

SEQ ID NO: 495 - DNA, 20 bp, Artificial Sequence
  Description of Artificial Sequence: Synthetic oligonucleotide
cgatcggaagcgatcggaag

SEQ ID NO: 496 - DNA, 20 bp, Artificial Sequence
  Description of Artificial Sequence: Synthetic oligonucleotide
cgatctaccgcgatctaccg

SEQ ID NO: 497 - DNA, 20 bp, Artificial Sequence
  Description of Artificial Sequence: Synthetic oligonucleotide
cgccaagcttcgccaagctt

SEQ ID NO: 498 - DNA, 20 bp, Artificial Sequence
  Description of Artificial Sequence: Synthetic oligonucleotide
cgccagaattcgccagaatt

SEQ ID NO: 499 - DNA, 20 bp, Artificial Sequence
  Description of Artificial Sequence: Synthetic oligonucleotide
cgcgaatggacgcgaatgga

SEQ ID NO: 500 - DNA, 20 bp, Artificial Sequence
  Description of Artificial Sequence: Synthetic oligonucleotide
cgctcatcctcgctcatcct

SEQ ID NO: 501 - DNA, 20 bp, Artificial Sequence
  Description of Artificial Sequence: Synthetic oligonucleotide
cgctcgaatgcgctcgaatg

SEQ ID NO: 502 - DNA, 20 bp, Artificial Sequence
  Description of Artificial Sequence: Synthetic oligonucleotide
cgcttactatcgcttactat

SEQ ID NO: 503 - DNA, 20 bp, Artificial Sequence
  Description of Artificial Sequence: Synthetic oligonucleotide
cgcttagcgtcgcttagcgt

SEQ ID NO: 504 - DNA, 20 bp, Artificial Sequence
  Description of Artificial Sequence: Synthetic oligonucleotide
cggacttaagcggacttaag

SEQ ID NO: 505 - DNA, 20 bp, Artificial Sequence
  Description of Artificial Sequence: Synthetic oligonucleotide
cggcgaacaacggcgaacaa

SEQ ID NO: 506 - DNA, 20 bp, Artificial Sequence
  Description of Artificial Sequence: Synthetic oligonucleotide
cggcttggaacggcttggaa

SEQ ID NO: 507 - DNA, 20 bp, Artificial Sequence
  Description of Artificial Sequence: Synthetic oligonucleotide
cggtagtgctcggtagtgct

SEQ ID NO: 508 - DNA, 20 bp, Artificial Sequence
  Description of Artificial Sequence: Synthetic oligonucleotide
cggttacacacggttacaca

SEQ ID NO: 509 - DNA, 20 bp, Artificial Sequence
  Description of Artificial Sequence: Synthetic oligonucleotide
cgtaccgtgtcgtaccgtgt

SEQ ID NO: 510 - DNA, 20 bp, Artificial Sequence
  Description of Artificial Sequence: Synthetic oligonucleotide
cgtagagccacgtagagcca

SEQ ID NO: 511 - DNA, 20 bp, Artificial Sequence
  Description of Artificial Sequence: Synthetic oligonucleotide
cgtaggactgcgtaggactg

SEQ ID NO: 512 - DNA, 20 bp, Artificial Sequence
  Description of Artificial Sequence: Synthetic oligonucleotide
cgtatcacaacgtatcacaa

SEQ ID NO: 513 - DNA, 20 bp, Artificial Sequence
  Description of Artificial Sequence: Synthetic oligonucleotide
cgtgttgcgacgtgttgcga

SEQ ID NO: 514 - DNA, 20 bp, Artificial Sequence
  Description of Artificial Sequence: Synthetic oligonucleotide
cgttggtccacgttggtcca

SEQ ID NO: 515 - DNA, 20 bp, Artificial Sequence
  Description of Artificial Sequence: Synthetic oligonucleotide
ctacagccgactacagccga

SEQ ID NO: 516 - DNA, 20 bp, Artificial Sequence
  Description of Artificial Sequence: Synthetic oligonucleotide
ctacgcaaggctacgcaagg

SEQ ID NO: 517 - DNA, 20 bp, Artificial Sequence
  Description of Artificial Sequence: Synthetic oligonucleotide
ctacggtgtgctacggtgtg

SEQ ID NO: 518 - DNA, 20 bp, Artificial Sequence
  Description of Artificial Sequence: Synthetic oligonucleotide
ctacgttcctctacgttcct

SEQ ID NO: 519 - DNA, 20 bp, Artificial Sequence
  Description of Artificial Sequence: Synthetic oligonucleotide
ctagaggcagctagaggcag

SEQ ID NO: 520 - DNA, 20 bp, Artificial Sequence
  Description of Artificial Sequence: Synthetic oligonucleotide
ctaggtccagctaggtccag

SEQ ID NO: 521 - DNA, 20 bp, Artificial Sequence
  Description of Artificial Sequence: Synthetic oligonucleotide
ctaggtcgctctaggtcgct

SEQ ID NO: 522 - DNA, 20 bp, Artificial Sequence
  Description of Artificial Sequence: Synthetic oligonucleotide
ctatcgccgtctatcgccgt

SEQ ID NO: 523 - DNA, 20 bp, Artificial Sequence
  Description of Artificial Sequence: Synthetic oligonucleotide
ctatggatctctatggatct

SEQ ID NO: 524 - DNA, 20 bp, Artificial Sequence
  Description of Artificial Sequence: Synthetic oligonucleotide
ctcgcgagttctcgcgagtt

SEQ ID NO: 525 - DNA, 20 bp, Artificial Sequence
  Description of Artificial Sequence: Synthetic oligonucleotide
ctcgtggcaactcgtggcaa

SEQ ID NO: 526 - DNA, 20 bp, Artificial Sequence
  Description of Artificial Sequence: Synthetic oligonucleotide
ctctacaactctctacaact

SEQ ID NO: 527 - DNA, 20 bp, Artificial Sequence
  Description of Artificial Sequence: Synthetic oligonucleotide
ctctatatcgctctatatcg

SEQ ID NO: 528 - DNA, 20 bp, Artificial Sequence
  Description of Artificial Sequence: Synthetic oligonucleotide
ctctccttcactctccttca

SEQ ID NO: 529 - DNA, 20 bp, Artificial Sequence
  Description of Artificial Sequence: Synthetic oligonucleotide
ctctcttgcgctctcttgcg

SEQ ID NO: 530 - DNA, 20 bp, Artificial Sequence
  Description of Artificial Sequence: Synthetic oligonucleotide
ctctgcgttgctctgcgttg

SEQ ID NO: 531 - DNA, 20 bp, Artificial Sequence
  Description of Artificial Sequence: Synthetic oligonucleotide
ctgaatccagctgaatccag

SEQ ID NO: 532 - DNA, 20 bp, Artificial Sequence
  Description of Artificial Sequence: Synthetic oligonucleotide
ctgagcttggctgagcttgg

SEQ ID NO: 533 - DNA, 20 bp, Artificial Sequence
  Description of Artificial Sequence: Synthetic oligonucleotide
ctggatccgactggatccga

SEQ ID NO: 534 - DNA, 20 bp, Artificial Sequence
  Description of Artificial Sequence: Synthetic oligonucleotide
ctggtctgatctggtctgat

SEQ ID NO: 535 - DNA, 20 bp, Artificial Sequence
  Description of Artificial Sequence: Synthetic oligonucleotide
ctgtccacagctgtccacag

SEQ ID NO: 536 - DNA, 20 bp, Artificial Sequence
  Description of Artificial Sequence: Synthetic oligonucleotide
ctgtcctcctctgtcctcct

SEQ ID NO: 537 - DNA, 20 bp, Artificial Sequence
  Description of Artificial Sequence: Synthetic oligonucleotide
ctgtcggatgctgtcggatg

SEQ ID NO: 538 - DNA, 20 bp, Artificial Sequence
  Description of Artificial Sequence: Synthetic oligonucleotide
cttcatctgacttcatctga

SEQ ID NO: 539 - DNA, 20 bp, Artificial Sequence
  Description of Artificial Sequence: Synthetic oligonucleotide
cttcctgcgtcttcctgcgt

SEQ ID NO: 540 - DNA, 20 bp, Artificial Sequence
  Description of Artificial Sequence: Synthetic oligonucleotide
cttcggctagcttcggctag

SEQ ID NO: 541 - DNA, 20 bp, Artificial Sequence
  Description of Artificial Sequence: Synthetic oligonucleotide
cttcttatggcttcttatgg

SEQ ID NO: 542 - DNA, 20 bp, Artificial Sequence
  Description of Artificial Sequence: Synthetic oligonucleotide
cttcttggatcttcttggat

SEQ ID NO: 543 - DNA, 20 bp, Artificial Sequence
  Description of Artificial Sequence: Synthetic oligonucleotide
cttgcgatggcttgcgatgg

SEQ ID NO: 544 - DNA, 20 bp, Artificial Sequence
  Description of Artificial Sequence: Synthetic oligonucleotide
gaacctcagcgaacctcagc

SEQ ID NO: 545 - DNA, 20 bp, Artificial Sequence
  Description of Artificial Sequence: Synthetic oligonucleotide
gaacggattagaacggatta

SEQ ID NO: 546 - DNA, 20 bp, Artificial Sequence
  Description of Artificial Sequence: Synthetic oligonucleotide
gaacgtcattgaacgtcatt

SEQ ID NO: 547 - DNA, 20 bp, Artificial Sequence
  Description of Artificial Sequence: Synthetic oligonucleotide
gaactgatccgaactgatcc

SEQ ID NO: 548 - DNA, 20 bp, Artificial Sequence
  Description of Artificial Sequence: Synthetic oligonucleotide
gacagcagtcgacagcagtc

SEQ ID NO: 549 - DNA, 20 bp, Artificial Sequence
  Description of Artificial Sequence: Synthetic oligonucleotide
gaccgaatgtgaccgaatgt

SEQ ID NO: 550 - DNA, 20 bp, Artificial Sequence
  Description of Artificial Sequence: Synthetic oligonucleotide
gacgccatcagacgccatca

SEQ ID NO: 551 - DNA, 20 bp, Artificial Sequence
  Description of Artificial Sequence: Synthetic oligonucleotide
gacgcgatacgacgcgatac

SEQ ID NO: 552 - DNA, 20 bp, Artificial Sequence
  Description of Artificial Sequence: Synthetic oligonucleotide
gacgctgtgagacgctgtga

SEQ ID NO: 553 - DNA, 20 bp, Artificial Sequence
  Description of Artificial Sequence: Synthetic oligonucleotide
gacggaccttgacggacctt

SEQ ID NO: 554 - DNA, 20 bp, Artificial Sequence
  Description of Artificial Sequence: Synthetic oligonucleotide
gacggagtctgacggagtct

SEQ ID NO: 555 - DNA, 20 bp, Artificial Sequence
  Description of Artificial Sequence: Synthetic oligonucleotide
gagcacaaccgagcacaacc

SEQ ID NO: 556 - DNA, 20 bp, Artificial Sequence
  Description of Artificial Sequence: Synthetic oligonucleotide
gaggaagaccgaggaagacc

SEQ ID NO: 557 - DNA, 20 bp, Artificial Sequence
  Description of Artificial Sequence: Synthetic oligonucleotide
gaggcacgatgaggcacgat

SEQ ID NO: 558 - DNA, 20 bp, Artificial Sequence
  Description of Artificial Sequence: Synthetic oligonucleotide
gaggtgaagcgaggtgaagc

SEQ ID NO: 559 - DNA, 20 bp, Artificial Sequence
  Description of Artificial Sequence: Synthetic oligonucleotide
gagtcacaccgagtcacacc

SEQ ID NO: 560 - DNA, 20 bp, Artificial Sequence
  Description of Artificial Sequence: Synthetic oligonucleotide
gagtccagacgagtccagac

SEQ ID NO: 561 - DNA, 20 bp, Artificial Sequence
  Description of Artificial Sequence: Synthetic oligonucleotide
gataacctgtgataacctgt

SEQ ID NO: 562 - DNA, 20 bp, Artificial Sequence
  Description of Artificial Sequence: Synthetic oligonucleotide
gatccaaggcgatccaaggc

SEQ ID NO: 563 - DNA, 20 bp, Artificial Sequence
  Description of Artificial Sequence: Synthetic oligonucleotide
gatcgagccagatcgagcca

SEQ ID NO: 564 - DNA, 20 bp, Artificial Sequence
  Description of Artificial Sequence: Synthetic oligonucleotide
gatggcaatcgatggcaatc

SEQ ID NO: 565 - DNA, 20 bp, Artificial Sequence
  Description of Artificial Sequence: Synthetic oligonucleotide
gattaccaacgattaccaac

SEQ ID NO: 566 - DNA, 20 bp, Artificial Sequence
  Description of Artificial Sequence: Synthetic oligonucleotide
gattcgtcttgattcgtctt

SEQ ID NO: 567 - DNA, 20 bp, Artificial Sequence
  Description of Artificial Sequence: Synthetic oligonucleotide
gattgttggagattgttgga

SEQ ID NO: 568 - DNA, 20 bp, Artificial Sequence
  Description of Artificial Sequence: Synthetic oligonucleotide
gcaacacggagcaacacgga

SEQ ID NO: 569 - DNA, 20 bp, Artificial Sequence
  Description of Artificial Sequence: Synthetic oligonucleotide
gcaatggtacgcaatggtac

SEQ ID NO: 570 - DNA, 20 bp, Artificial Sequence
  Description of Artificial Sequence: Synthetic oligonucleotide
gcaccacattgcaccacatt

SEQ ID NO: 571 - DNA, 20 bp, Artificial Sequence
  Description of Artificial Sequence: Synthetic oligonucleotide
gcagattggcgcagattggc

SEQ ID NO: 572 - DNA, 20 bp, Artificial Sequence
  Description of Artificial Sequence: Synthetic oligonucleotide
gcaggatagcgcaggatagc

SEQ ID NO: 573 - DNA, 20 bp, Artificial Sequence
  Description of Artificial Sequence: Synthetic oligonucleotide
gcattaatccgcattaatcc

SEQ ID NO: 574 - DNA, 20 bp, Artificial Sequence
  Description of Artificial Sequence: Synthetic oligonucleotide
gccaccatctgccaccatct

SEQ ID NO: 575 - DNA, 20 bp, Artificial Sequence
  Description of Artificial Sequence: Synthetic oligonucleotide
gccagataccgccagatacc

SEQ ID NO: 576 - DNA, 20 bp, Artificial Sequence
  Description of Artificial Sequence: Synthetic oligonucleotide
gccatagatagccatagata

SEQ ID NO: 577 - DNA, 20 bp, Artificial Sequence
  Description of Artificial Sequence: Synthetic oligonucleotide
gccattggacgccattggac

SEQ ID NO: 578 - DNA, 20 bp, Artificial Sequence
  Description of Artificial Sequence: Synthetic oligonucleotide
gccgaatcctgccgaatcct

SEQ ID NO: 579 - DNA, 20 bp, Artificial Sequence
  Description of Artificial Sequence: Synthetic oligonucleotide
gccgtgtctagccgtgtcta

SEQ ID NO: 580 - DNA, 20 bp, Artificial Sequence
  Description of Artificial Sequence: Synthetic oligonucleotide
gccttatctcgccttatctc

SEQ ID NO: 581 - DNA, 20 bp, Artificial Sequence
  Description of Artificial Sequence: Synthetic oligonucleotide
gccttcgcttgccttcgctt

SEQ ID NO: 582 - DNA, 20 bp, Artificial Sequence
  Description of Artificial Sequence: Synthetic oligonucleotide
gcgaagtggtgcgaagtggt

SEQ ID NO: 583 - DNA, 20 bp, Artificial Sequence
  Description of Artificial Sequence: Synthetic oligonucleotide
gcgaatatctgcgaatatct

SEQ ID NO: 584 - DNA, 20 bp, Artificial Sequence
  Description of Artificial Sequence: Synthetic oligonucleotide
gcgctgatacgcgctgatac

SEQ ID NO: 585 - DNA, 20 bp, Artificial Sequence
  Description of Artificial Sequence: Synthetic oligonucleotide
gcggacttctgcggacttct

SEQ ID NO: 586 - DNA, 20 bp, Artificial Sequence
  Description of Artificial Sequence: Synthetic oligonucleotide
gcggataagtgcggataagt

SEQ ID NO: 587 - DNA, 20 bp, Artificial Sequence
  Description of Artificial Sequence: Synthetic oligonucleotide
gcggtccattgcggtccatt

SEQ ID NO: 588 - DNA, 20 bp, Artificial Sequence
  Description of Artificial Sequence: Synthetic oligonucleotide
gctcagttaagctcagttaa

SEQ ID NO: 589 - DNA, 20 bp, Artificial Sequence
  Description of Artificial Sequence: Synthetic oligonucleotide
gctcattctagctcattcta

SEQ ID NO: 590 - DNA, 20 bp, Artificial Sequence
  Description of Artificial Sequence: Synthetic oligonucleotide
gctcctaagcgctcctaagc

SEQ ID NO: 591 - DNA, 20 bp, Artificial Sequence
  Description of Artificial Sequence: Synthetic oligonucleotide
gctggaaggagctggaagga

SEQ ID NO: 592 - DNA, 20 bp, Artificial Sequence
  Description of Artificial Sequence: Synthetic oligonucleotide
ggaacaatgtggaacaatgt

SEQ ID NO: 593 - DNA, 20 bp, Artificial Sequence
  Description of Artificial Sequence: Synthetic oligonucleotide
ggaacatctcggaacatctc

SEQ ID NO: 594 - DNA, 20 bp, Artificial Sequence
  Description of Artificial Sequence: Synthetic oligonucleotide
ggaaccagtaggaaccagta

SEQ ID NO: 595 - DNA, 20 bp, Artificial Sequence
  Description of Artificial Sequence: Synthetic oligonucleotide
ggaacgacttggaacgactt

SEQ ID NO: 596 - DNA, 20 bp, Artificial Sequence
  Description of Artificial Sequence: Synthetic oligonucleotide
ggaagatgatggaagatgat

SEQ ID NO: 597 - DNA, 20 bp, Artificial Sequence
  Description of Artificial Sequence: Synthetic oligonucleotide
ggaaggagacggaaggagac

SEQ ID NO: 598 - DNA, 20 bp, Artificial Sequence
  Description of Artificial Sequence: Synthetic oligonucleotide
ggaagtggtaggaagtggta

SEQ ID NO: 599 - DNA, 20 bp, Artificial Sequence
  Description of Artificial Sequence: Synthetic oligonucleotide
ggaatcaggtggaatcaggt

SEQ ID NO: 600 - DNA, 20 bp, Artificial Sequence
  Description of Artificial Sequence: Synthetic oligonucleotide
ggaatgtgtaggaatgtgta

SEQ ID NO: 601 - DNA, 20 bp, Artificial Sequence
  Description of Artificial Sequence: Synthetic oligonucleotide
ggagataggaggagatagga

SEQ ID NO: 602 - DNA, 20 bp, Artificial Sequence
  Description of Artificial Sequence: Synthetic oligonucleotide
ggagcaatccggagcaatcc

SEQ ID NO: 603 - DNA, 20 bp, Artificial Sequence
  Description of Artificial Sequence: Synthetic oligonucleotide
ggaggacatcggaggacatc

SEQ ID NO: 604 - DNA, 20 bp, Artificial Sequence
  Description of Artificial Sequence: Synthetic oligonucleotide
ggcaatagccggcaatagcc

SEQ ID NO: 605 - DNA, 20 bp, Artificial Sequence
  Description of Artificial Sequence: Synthetic oligonucleotide
ggcagaaggaggcagaagga

SEQ ID NO: 606 - DNA, 20 bp, Artificial Sequence
  Description of Artificial Sequence: Synthetic oligonucleotide
ggcaggaataggcaggaata

SEQ ID NO: 607 - DNA, 20 bp, Artificial Sequence
  Description of Artificial Sequence: Synthetic oligonucleotide
ggcatacaccggcatacacc

SEQ ID NO: 608 - DNA, 20 bp, Artificial Sequence
  Description of Artificial Sequence: Synthetic oligonucleotide
ggccgttgtaggccgttgta

SEQ ID NO: 609 - DNA, 20 bp, Artificial Sequence
  Description of Artificial Sequence: Synthetic oligonucleotide
ggcctgcttaggcctgctta

SEQ ID NO: 610 - DNA, 20 bp, Artificial Sequence
  Description of Artificial Sequence: Synthetic oligonucleotide
ggcgaggtaaggcgaggtaa

SEQ ID NO: 611 - DNA, 20 bp, Artificial Sequence
  Description of Artificial Sequence: Synthetic oligonucleotide
ggcgtgacatggcgtgacat

SEQ ID NO: 612 - DNA, 20 bp, Artificial Sequence
  Description of Artificial Sequence: Synthetic oligonucleotide
ggctccaagaggctccaaga

SEQ ID NO: 613 - DNA, 20 bp, Artificial Sequence
  Description of Artificial Sequence: Synthetic oligonucleotide
ggctgctcaaggctgctcaa

SEQ ID NO: 614 - DNA, 20 bp, Artificial Sequence
  Description of Artificial Sequence: Synthetic oligonucleotide
ggctgtgcttggctgtgctt

SEQ ID NO: 615 - DNA, 20 bp, Artificial Sequence
  Description of Artificial Sequence: Synthetic oligonucleotide
ggcttctgtcggcttctgtc

SEQ ID NO: 616 - DNA, 20 bp, Artificial Sequence
  Description of Artificial Sequence: Synthetic oligonucleotide
ggtatcgcttggtatcgctt

SEQ ID NO: 617 - DNA, 20 bp, Artificial Sequence
  Description of Artificial Sequence: Synthetic oligonucleotide
ggtccttccaggtccttcca

SEQ ID NO: 618 - DNA, 20 bp, Artificial Sequence
  Description of Artificial Sequence: Synthetic oligonucleotide
ggtcggttatggtcggttat

SEQ ID NO: 619 - DNA, 20 bp, Artificial Sequence
  Description of Artificial Sequence: Synthetic oligonucleotide
ggtctgacgaggtctgacga

SEQ ID NO: 620 - DNA, 20 bp, Artificial Sequence
  Description of Artificial Sequence: Synthetic oligonucleotide
ggtgaccactggtgaccact

SEQ ID NO: 621 - DNA, 20 bp, Artificial Sequence
  Description of Artificial Sequence: Synthetic oligonucleotide
ggtgagtccaggtgagtcca

SEQ ID NO: 622 - DNA, 20 bp, Artificial Sequence
  Description of Artificial Sequence: Synthetic oligonucleotide
ggtggcgaatggtggcgaat

SEQ ID NO: 623 - DNA, 20 bp, Artificial Sequence
  Description of Artificial Sequence: Synthetic oligonucleotide
ggtgtatatcggtgtatatc

SEQ ID NO: 624 - DNA, 20 bp, Artificial Sequence
  Description of Artificial Sequence: Synthetic oligonucleotide
ggttccttaaggttccttaa

SEQ ID NO: 625 - DNA, 20 bp, Artificial Sequence
  Description of Artificial Sequence: Synthetic oligonucleotide
ggttctacaaggttctacaa

SEQ ID NO: 626 - DNA, 20 bp, Artificial Sequence
  Description of Artificial Sequence: Synthetic oligonucleotide
ggttggcgttggttggcgtt

SEQ ID NO: 627 - DNA, 20 bp, Artificial Sequence
  Description of Artificial Sequence: Synthetic oligonucleotide
gtaacacgctgtaacacgct

SEQ ID NO: 628 - DNA, 20 bp, Artificial Sequence
  Description of Artificial Sequence: Synthetic oligonucleotide
gtagagcgacgtagagcgac

SEQ ID NO: 629 - DNA, 20 bp, Artificial Sequence
  Description of Artificial Sequence: Synthetic oligonucleotide
gtagctgctcgtagctgctc

SEQ ID NO: 630 - DNA, 20 bp, Artificial Sequence
  Description of Artificial Sequence: Synthetic oligonucleotide
gtaggtggatgtaggtggat

SEQ ID NO: 631 - DNA, 20 bp, Artificial Sequence
  Description of Artificial Sequence: Synthetic oligonucleotide
gtagtcagccgtagtcagcc

SEQ ID NO: 632 - DNA, 20 bp, Artificial Sequence
  Description of Artificial Sequence: Synthetic oligonucleotide
gtccttccacgtccttccac

SEQ ID NO: 633 - DNA, 20 bp, Artificial Sequence
  Description of Artificial Sequence: Synthetic oligonucleotide
gtcgagcagtgtcgagcagt

SEQ ID NO: 634 - DNA, 20 bp, Artificial Sequence
  Description of Artificial Sequence: Synthetic oligonucleotide
gtcgcacagagtcgcacaga

SEQ ID NO: 635 - DNA, 20 bp, Artificial Sequence
  Description of Artificial Sequence: Synthetic oligonucleotide
gtcgcacttcgtcgcacttc

SEQ ID NO: 636 - DNA, 20 bp, Artificial Sequence
  Description of Artificial Sequence: Synthetic oligonucleotide
gtctggtggtgtctggtggt

SEQ ID NO: 637 - DNA, 20 bp, Artificial Sequence
  Description of Artificial Sequence: Synthetic oligonucleotide
gtgaactgttgtgaactgtt

SEQ ID NO: 638 - DNA, 20 bp, Artificial Sequence
  Description of Artificial Sequence: Synthetic oligonucleotide
gtgccatcctgtgccatcct

SEQ ID NO: 639 - DNA, 20 bp, Artificial Sequence
  Description of Artificial Sequence: Synthetic oligonucleotide
gtgcgtgaacgtgcgtgaac

SEQ ID NO: 640 - DNA, 20 bp, Artificial Sequence
  Description of Artificial Sequence: Synthetic oligonucleotide
gtggagatgtgtggagatgt

SEQ ID NO: 641 - DNA, 20 bp, Artificial Sequence
  Description of Artificial Sequence: Synthetic oligonucleotide
gtggtgcaacgtggtgcaac

SEQ ID NO: 642 - DNA, 20 bp, Artificial Sequence
  Description of Artificial Sequence: Synthetic oligonucleotide
gtgtcgttaagtgtcgttaa

SEQ ID NO: 643 - DNA, 20 bp, Artificial Sequence
  Description of Artificial Sequence: Synthetic oligonucleotide
gtgtctcaatgtgtctcaat

SEQ ID NO: 644 - DNA, 20 bp, Artificial Sequence
  Description of Artificial Sequence: Synthetic oligonucleotide
gtgtgatgacgtgtgatgac

SEQ ID NO: 645 - DNA, 20 bp, Artificial Sequence
  Description of Artificial Sequence: Synthetic oligonucleotide
gttagatcgcgttagatcgc

SEQ ID NO: 646 - DNA, 20 bp, Artificial Sequence
  Description of Artificial Sequence: Synthetic oligonucleotide
taagccgatataagccgata

SEQ ID NO: 647 - DNA, 20 bp, Artificial Sequence
  Description of Artificial Sequence: Synthetic oligonucleotide
taaggacacctaaggacacc

SEQ ID NO: 648 - DNA, 20 bp, Artificial Sequence
  Description of Artificial Sequence: Synthetic oligonucleotide
taaggccaagtaaggccaag

SEQ ID NO: 649 - DNA, 20 bp, Artificial Sequence
  Description of Artificial Sequence: Synthetic oligonucleotide
taatagcgagtaatagcgag

SEQ ID NO: 650 - DNA, 20 bp, Artificial Sequence
  Description of Artificial Sequence: Synthetic oligonucleotide
taatggccggtaatggccgg

SEQ ID NO: 651 - DNA, 20 bp, Artificial Sequence
  Description of Artificial Sequence: Synthetic oligonucleotide
taccattggataccattgga

SEQ ID NO: 652 - DNA, 20 bp, Artificial Sequence
  Description of Artificial Sequence: Synthetic oligonucleotide
tacgaccacctacgaccacc

SEQ ID NO: 653 - DNA, 20 bp, Artificial Sequence
  Description of Artificial Sequence: Synthetic oligonucleotide
tacgaccttatacgacctta

SEQ ID NO: 654 - DNA, 20 bp, Artificial Sequence
  Description of Artificial Sequence: Synthetic oligonucleotide
tacgtgattctacgtgattc

SEQ ID NO: 655 - DNA, 20 bp, Artificial Sequence
  Description of Artificial Sequence: Synthetic oligonucleotide
tactagtcagtactagtcag

SEQ ID NO: 656 - DNA, 20 bp, Artificial Sequence
  Description of Artificial Sequence: Synthetic oligonucleotide
tactgacaagtactgacaag

SEQ ID NO: 657 - DNA, 20 bp, Artificial Sequence
  Description of Artificial Sequence: Synthetic oligonucleotide
tactgctggctactgctggc

SEQ ID NO: 658 - DNA, 20 bp, Artificial Sequence
  Description of Artificial Sequence: Synthetic oligonucleotide
tagaccgtaatagaccgtaa

SEQ ID NO: 659 - DNA, 20 bp, Artificial Sequence
  Description of Artificial Sequence: Synthetic oligonucleotide
tagacgaagatagacgaaga

SEQ ID NO: 660 - DNA, 20 bp, Artificial Sequence
  Description of Artificial Sequence: Synthetic oligonucleotide
tagcctagcctagcctagcc

SEQ ID NO: 661 - DNA, 20 bp, Artificial Sequence
  Description of Artificial Sequence: Synthetic oligonucleotide
tagcgaattctagcgaattc

SEQ ID NO: 662 - DNA, 20 bp, Artificial Sequence
  Description of Artificial Sequence: Synthetic oligonucleotide
tagctgccactagctgccac

SEQ ID NO: 663 - DNA, 20 bp, Artificial Sequence
  Description of Artificial Sequence: Synthetic oligonucleotide
taggtaggcataggtaggca

SEQ ID NO: 664 - DNA, 20 bp, Artificial Sequence
  Description of Artificial Sequence: Synthetic oligonucleotide
tagtcgttactagtcgttac

SEQ ID NO: 665 - DNA, 20 bp, Artificial Sequence
  Description of Artificial Sequence: Synthetic oligonucleotide
tagtgcgaagtagtgcgaag

SEQ ID NO: 666 - DNA, 20 bp, Artificial Sequence
  Description of Artificial Sequence: Synthetic oligonucleotide
tagtggacgctagtggacgc

SEQ ID NO: 667 - DNA, 20 bp, Artificial Sequence
  Description of Artificial Sequence: Synthetic oligonucleotide
tataacggtgtataacggtg

SEQ ID NO: 668 - DNA, 20 bp, Artificial Sequence
  Description of Artificial Sequence: Synthetic oligonucleotide
tatagaaccgtatagaaccg

SEQ ID NO: 669 - DNA, 20 bp, Artificial Sequence
  Description of Artificial Sequence: Synthetic oligonucleotide
tatccgaaggtatccgaagg

SEQ ID NO: 670 - DNA, 20 bp, Artificial Sequence
  Description of Artificial Sequence: Synthetic oligonucleotide
tatcggagcctatcggagcc

SEQ ID NO: 671 - DNA, 20 bp, Artificial Sequence
  Description of Artificial Sequence: Synthetic oligonucleotide
tatcggcctgtatcggcctg

SEQ ID NO: 672 - DNA, 20 bp, Artificial Sequence
  Description of Artificial Sequence: Synthetic oligonucleotide
tatcgtcggctatcgtcggc

SEQ ID NO: 673 - DNA, 20 bp, Artificial Sequence
  Description of Artificial Sequence: Synthetic oligonucleotide
tatgcgccactatgcgccac

SEQ ID NO: 674 - DNA, 20 bp, Artificial Sequence
  Description of Artificial Sequence: Synthetic oligonucleotide
tatggccgtctatggccgtc

SEQ ID NO: 675 - DNA, 20 bp, Artificial Sequence
  Description of Artificial Sequence: Synthetic oligonucleotide
tattcttccgtattcttccg

SEQ ID NO: 676 - DNA, 20 bp, Artificial Sequence
  Description of Artificial Sequence: Synthetic oligonucleotide
tcaagcaacgtcaagcaacg

SEQ ID NO: 677 - DNA, 20 bp, Artificial Sequence
  Description of Artificial Sequence: Synthetic oligonucleotide
tcaagcagtctcaagcagtc

SEQ ID NO: 678 - DNA, 20 bp, Artificial Sequence
  Description of Artificial Sequence: Synthetic oligonucleotide
tcaagtccgatcaagtccga

SEQ ID NO: 679 - DNA, 20 bp, Artificial Sequence
  Description of Artificial Sequence: Synthetic oligonucleotide
tcaatcgagatcaatcgaga

SEQ ID NO: 680 - DNA, 20 bp, Artificial Sequence
  Description of Artificial Sequence: Synthetic oligonucleotide
tcaatgtcgatcaatgtcga

SEQ ID NO: 681 - DNA, 20 bp, Artificial Sequence
  Description of Artificial Sequence: Synthetic oligonucleotide
tcactgaggctcactgaggc

SEQ ID NO: 682 - DNA, 20 bp, Artificial Sequence
  Description of Artificial Sequence: Synthetic oligonucleotide
tcagcgagactcagcgagac

SEQ ID NO: 683 - DNA, 20 bp, Artificial Sequence
  Description of Artificial Sequence: Synthetic oligonucleotide
tcaggaggaatcaggaggaa

SEQ ID NO: 684 - DNA, 20 bp, Artificial Sequence
  Description of Artificial Sequence: Synthetic oligonucleotide
tcaggcacagtcaggcacag

SEQ ID NO: 685 - DNA, 20 bp, Artificial Sequence
  Description of Artificial Sequence: Synthetic oligonucleotide
tcaggcttcctcaggcttcc

SEQ ID NO: 686 - DNA, 20 bp, Artificial Sequence
  Description of Artificial Sequence: Synthetic oligonucleotide
tccacactcgtccacactcg

SEQ ID NO: 687 - DNA, 20 bp, Artificial Sequence
  Description of Artificial Sequence: Synthetic oligonucleotide
tccacagcgatccacagcga

SEQ ID NO: 688 - DNA, 20 bp, Artificial Sequence
  Description of Artificial Sequence: Synthetic oligonucleotide
tccagctgcatccagctgca

SEQ ID NO: 689 - DNA, 20 bp, Artificial Sequence
  Description of Artificial Sequence: Synthetic oligonucleotide
tccataatcctccataatcc

SEQ ID NO: 690 - DNA, 20 bp, Artificial Sequence
  Description of Artificial Sequence: Synthetic oligonucleotide
tccggaccaatccggaccaa

SEQ ID NO: 691 - DNA, 20 bp, Artificial Sequence
  Description of Artificial Sequence: Synthetic oligonucleotide
tccgtaacggtccgtaacgg

SEQ ID NO: 692 - DNA, 20 bp, Artificial Sequence
  Description of Artificial Sequence: Synthetic oligonucleotide
tccgtaggtctccgtaggtc

SEQ ID NO: 693 - DNA, 20 bp, Artificial Sequence
  Description of Artificial Sequence: Synthetic oligonucleotide
tccgtccaagtccgtccaag

SEQ ID NO: 694 - DNA, 20 bp, Artificial Sequence
  Description of Artificial Sequence: Synthetic oligonucleotide
tcctgaaccgtcctgaaccg

SEQ ID NO: 695 - DNA, 20 bp, Artificial Sequence
  Description of Artificial Sequence: Synthetic oligonucleotide
tcctggcatgtcctggcatg

SEQ ID NO: 696 - DNA, 20 bp, Artificial Sequence
  Description of Artificial Sequence: Synthetic oligonucleotide
tcgcgctacatcgcgctaca

SEQ ID NO: 697 - DNA, 20 bp, Artificial Sequence
  Description of Artificial Sequence: Synthetic oligonucleotide
tcggttaccatcggttacca

SEQ ID NO: 698 - DNA, 20 bp, Artificial Sequence
  Description of Artificial Sequence: Synthetic oligonucleotide
tcgtccgtcatcgtccgtca

SEQ ID NO: 699 - DNA, 20 bp, Artificial Sequence
  Description of Artificial Sequence: Synthetic oligonucleotide
tcgtcctcagtcgtcctcag

SEQ ID NO: 700 - DNA, 20 bp, Artificial Sequence
  Description of Artificial Sequence: Synthetic oligonucleotide
tctaccgctctctaccgctc

SEQ ID NO: 701 - DNA, 20 bp, Artificial Sequence
  Description of Artificial Sequence: Synthetic oligonucleotide
tctagctcggtctagctcgg

SEQ ID NO: 702 - DNA, 20 bp, Artificial Sequence
  Description of Artificial Sequence: Synthetic oligonucleotide
tctcggctgatctcggctga

SEQ ID NO: 703 - DNA, 20 bp, Artificial Sequence
  Description of Artificial Sequence: Synthetic oligonucleotide
tctcggtcagtctcggtcag

SEQ ID NO: 704 - DNA, 20 bp, Artificial Sequence
  Description of Artificial Sequence: Synthetic oligonucleotide
tctctagatctctctagatc

SEQ ID NO: 705 - DNA, 20 bp, Artificial Sequence
  Description of Artificial Sequence: Synthetic oligonucleotide
tctgaccgcatctgaccgca

SEQ ID NO: 706 - DNA, 20 bp, Artificial Sequence
  Description of Artificial Sequence: Synthetic oligonucleotide
tctggacagatctggacaga

SEQ ID NO: 707 - DNA, 20 bp, Artificial Sequence
  Description of Artificial Sequence: Synthetic oligonucleotide
tctggataagtctggataag

SEQ ID NO: 708 - DNA, 20 bp, Artificial Sequence
  Description of Artificial Sequence: Synthetic oligonucleotide
tcttacggcctcttacggcc

SEQ ID NO: 709 - DNA, 20 bp, Artificial Sequence
  Description of Artificial Sequence: Synthetic oligonucleotide
tcttgcatactcttgcatac

SEQ ID NO: 710 - DNA, 20 bp, Artificial Sequence
  Description of Artificial Sequence: Synthetic oligonucleotide
tgaacttggatgaacttgga

SEQ ID NO: 711 - DNA, 20 bp, Artificial Sequence
  Description of Artificial Sequence: Synthetic oligonucleotide
tgacacagcgtgacacagcg

SEQ ID NO: 712 - DNA, 20 bp, Artificial Sequence
  Description of Artificial Sequence: Synthetic oligonucleotide
tgacaggtcctgacaggtcc

SEQ ID NO: 713 - DNA, 20 bp, Artificial Sequence
  Description of Artificial Sequence: Synthetic oligonucleotide
tgaccttccgtgaccttccg

SEQ ID NO: 714 - DNA, 20 bp, Artificial Sequence
  Description of Artificial Sequence: Synthetic oligonucleotide
tgacgtcggatgacgtcgga

SEQ ID NO: 715 - DNA, 20 bp, Artificial Sequence
  Description of Artificial Sequence: Synthetic oligonucleotide
tgactatctctgactatctc

SEQ ID NO: 716 - DNA, 20 bp, Artificial Sequence
  Description of Artificial Sequence: Synthetic oligonucleotide
tgactccaggtgactccagg

SEQ ID NO: 717 - DNA, 20 bp, Artificial Sequence
  Description of Artificial Sequence: Synthetic oligonucleotide
tgagagcaggtgagagcagg

SEQ ID NO: 718 - DNA, 20 bp, Artificial Sequence
  Description of Artificial Sequence: Synthetic oligonucleotide
tgagcctccatgagcctcca

SEQ ID NO: 719 - DNA, 20 bp, Artificial Sequence
  Description of Artificial Sequence: Synthetic oligonucleotide
tgagtatggatgagtatgga

SEQ ID NO: 720 - DNA, 20 bp, Artificial Sequence
  Description of Artificial Sequence: Synthetic oligonucleotide
tgcaacatactgcaacatac

SEQ ID NO: 721 - DNA, 20 bp, Artificial Sequence
  Description of Artificial Sequence: Synthetic oligonucleotide
tgcgctgtagtgcgctgtag

SEQ ID NO: 722 - DNA, 20 bp, Artificial Sequence
  Description of Artificial Sequence: Synthetic oligonucleotide
tgctaaccggtgctaaccgg

SEQ ID NO: 723 - DNA, 20 bp, Artificial Sequence
  Description of Artificial Sequence: Synthetic oligonucleotide
tgctccactgtgctccactg

SEQ ID NO: 724 - DNA, 20 bp, Artificial Sequence
  Description of Artificial Sequence: Synthetic oligonucleotide
tggaaggagctggaaggagc

SEQ ID NO: 725 - DNA, 20 bp, Artificial Sequence
  Description of Artificial Sequence: Synthetic oligonucleotide
tggcagtgactggcagtgac

SEQ ID NO: 726 - DNA, 20 bp, Artificial Sequence
  Description of Artificial Sequence: Synthetic oligonucleotide
tggcatcagctggcatcagc

SEQ ID NO: 727 - DNA, 20 bp, Artificial Sequence
  Description of Artificial Sequence: Synthetic oligonucleotide
tggccttatatggccttata

SEQ ID NO: 728 - DNA, 20 bp, Artificial Sequence
  Description of Artificial Sequence: Synthetic oligonucleotide
tggcgaagcatggcgaagca

SEQ ID NO: 729 - DNA, 20 bp, Artificial Sequence
  Description of Artificial Sequence: Synthetic oligonucleotide
tggcttaagatggcttaaga

SEQ ID NO: 730 - DNA, 20 bp, Artificial Sequence
  Description of Artificial Sequence: Synthetic oligonucleotide
tggtcagctctggtcagctc

SEQ ID NO: 731 - DNA, 20 bp, Artificial Sequence
  Description of Artificial Sequence: Synthetic oligonucleotide
tggttccaactggttccaac

SEQ ID NO: 732 - DNA, 20 bp, Artificial Sequence
  Description of Artificial Sequence: Synthetic oligonucleotide
tggttggtaatggttggtaa

SEQ ID NO: 733 - DNA, 20 bp, Artificial Sequence
  Description of Artificial Sequence: Synthetic oligonucleotide
tgtacgcgcatgtacgcgca

SEQ ID NO: 734 - DNA, 20 bp, Artificial Sequence
  Description of Artificial Sequence: Synthetic oligonucleotide
tgtacgctggtgtacgctgg

SEQ ID NO: 735 - DNA, 20 bp, Artificial Sequence
  Description of Artificial Sequence: Synthetic oligonucleotide
tgtagcattgtgtagcattg

SEQ ID NO: 736 - DNA, 20 bp, Artificial Sequence
  Description of Artificial Sequence: Synthetic oligonucleotide
tgtagtgccgtgtagtgccg

SEQ ID NO: 737 - DNA, 20 bp, Artificial Sequence
  Description of Artificial Sequence: Synthetic oligonucleotide
tgtgaatctgtgtgaatctg

SEQ ID NO: 738 - DNA, 20 bp, Artificial Sequence
  Description of Artificial Sequence: Synthetic oligonucleotide
tgttccgtggtgttccgtgg

SEQ ID NO: 739 - DNA, 20 bp, Artificial Sequence
  Description of Artificial Sequence: Synthetic oligonucleotide
ttagcgcgtgttagcgcgtg

SEQ ID NO: 740 - DNA, 20 bp, Artificial Sequence
  Description of Artificial Sequence: Synthetic oligonucleotide
ttagttggacttagttggac

SEQ ID NO: 741 - DNA, 20 bp, Artificial Sequence
  Description of Artificial Sequence: Synthetic oligonucleotide
ttccaacttcttccaacttc

SEQ ID NO: 742 - DNA, 20 bp, Artificial Sequence
  Description of Artificial Sequence: Synthetic oligonucleotide
ttccgtcaggttccgtcagg

SEQ ID NO: 743 - DNA, 20 bp, Artificial Sequence
  Description of Artificial Sequence: Synthetic oligonucleotide
ttcctcaccgttcctcaccg

SEQ ID NO: 744 - DNA, 20 bp, Artificial Sequence
  Description of Artificial Sequence: Synthetic oligonucleotide
ttcctccgacttcctccgac

SEQ ID NO: 745 - DNA, 20 bp, Artificial Sequence
  Description of Artificial Sequence: Synthetic oligonucleotide
ttcgacctggttcgacctgg

SEQ ID NO: 746 - DNA, 20 bp, Artificial Sequence
  Description of Artificial Sequence: Synthetic oligonucleotide
ttcgcgtggattcgcgtgga

SEQ ID NO: 747 - DNA, 20 bp, Artificial Sequence
  Description of Artificial Sequence: Synthetic oligonucleotide
ttcggaagcgttcggaagcg

SEQ ID NO: 748 - DNA, 20 bp, Artificial Sequence
  Description of Artificial Sequence: Synthetic oligonucleotide
ttctcgattgttctcgattg

SEQ ID NO: 749 - DNA, 20 bp, Artificial Sequence
  Description of Artificial Sequence: Synthetic oligonucleotide
ttctctctagttctctctag

SEQ ID NO: 750 - DNA, 20 bp, Artificial Sequence
  Description of Artificial Sequence: Synthetic oligonucleotide
ttcttgcgcgttcttgcgcg

SEQ ID NO: 751 - DNA, 20 bp, Artificial Sequence
  Description of Artificial Sequence: Synthetic oligonucleotide
ttgaggtcggttgaggtcgg

SEQ ID NO: 752 - DNA, 20 bp, Artificial Sequence
  Description of Artificial Sequence: Synthetic oligonucleotide
ttgcacacgcttgcacacgc

SEQ ID NO: 753 - DNA, 20 bp, Artificial Sequence
  Description of Artificial Sequence: Synthetic oligonucleotide
ttgcgctctgttgcgctctg

SEQ ID NO: 754 - DNA, 20 bp, Artificial Sequence
  Description of Artificial Sequence: Synthetic oligonucleotide
ttgctgcagcttgctgcagc

SEQ ID NO: 755 - DNA, 20 bp, Artificial Sequence
  Description of Artificial Sequence: Synthetic oligonucleotide
ttggcgtctgttggcgtctg

SEQ ID NO: 756 - DNA, 20 bp, Artificial Sequence
  Description of Artificial Sequence: Synthetic oligonucleotide
ttggtccttcttggtccttc

SEQ ID NO: 757 - DNA, 20 bp, Artificial Sequence
  Description of Artificial Sequence: Synthetic oligonucleotide
ttgtcgagagttgtcgagag

SEQ ID NO: 758 - DNA, 20 bp, Artificial Sequence
  Description of Artificial Sequence: Synthetic oligonucleotide
ttgtctgtacttgtctgtac

SEQ ID NO: 759 - DNA, 20 bp, Artificial Sequence
  Description of Artificial Sequence: Synthetic oligonucleotide
ttgttctctcttgttctctc

SEQ ID NO: 760 - DNA, 20 bp, Artificial Sequence
  Description of Artificial Sequence: Synthetic oligonucleotide
aacacacgttaacacacgtt

SEQ ID NO: 761 - DNA, 20 bp, Artificial Sequence
  Description of Artificial Sequence: Synthetic oligonucleotide
aacatcgagtaacatcgagt

SEQ ID NO: 762 - DNA, 20 bp, Artificial Sequence
  Description of Artificial Sequence: Synthetic oligonucleotide
aaccgaggacaaccgaggac

SEQ ID NO: 763 - DNA, 20 bp, Artificial Sequence
  Description of Artificial Sequence: Synthetic oligonucleotide
aacctagtagaacctagtag

SEQ ID NO: 764 - DNA, 20 bp, Artificial Sequence
  Description of Artificial Sequence: Synthetic oligonucleotide
aacgcatactaacgcatact

SEQ ID NO: 765 - DNA, 20 bp, Artificial Sequence
  Description of Artificial Sequence: Synthetic oligonucleotide
aactaacctcaactaacctc

SEQ ID NO: 766 - DNA, 20 bp, Artificial Sequence
  Description of Artificial Sequence: Synthetic oligonucleotide
aactaaggagaactaaggag

SEQ ID NO: 767 - DNA, 20 bp, Artificial Sequence
  Description of Artificial Sequence: Synthetic oligonucleotide
aactcgttctaactcgttct

SEQ ID NO: 768 - DNA, 20 bp, Artificial Sequence
  Description of Artificial Sequence: Synthetic oligonucleotide
aactgccgctaactgccgct

SEQ ID NO: 769 - DNA, 24 bp, Artificial Sequence
  Description of Artificial Sequence: Synthetic oligonucleotide
  5' Phos
cagaggatatctgtggatatctgt

SEQ ID NO: 770 - DNA, 24 bp, Artificial Sequence
  Description of Artificial Sequence: Synthetic oligonucleotide
  5' Phos
cagaggctgccataggctgccata

SEQ ID NO: 771 - DNA, 24 bp, Artificial Sequence
  Description of Artificial Sequence: Synthetic oligonucleotide
  5' Phos
cagaggtatgtcaaggtatgtcaa

SEQ ID NO: 772 - DNA, 24 bp, Artificial Sequence
  Description of Artificial Sequence: Synthetic oligonucleotide
  5' Phos
cagaggtgaaggacggtgaaggac

SEQ ID NO: 773 - DNA, 24 bp, Artificial Sequence
  Description of Artificial Sequence: Synthetic oligonucleotide
  5' Phos
cagagtaccagcatgtaccagcat

SEQ ID NO: 774 - DNA, 24 bp, Artificial Sequence
  Description of Artificial Sequence: Synthetic oligonucleotide
  5' Phos
cagagtatacatccgtatacatcc

SEQ ID NO: 775 - DNA, 24 bp, Artificial Sequence
  Description of Artificial Sequence: Synthetic oligonucleotide
  5' Phos
cagagtatcgctcagtatcgctca

SEQ ID NO: 776 - DNA, 24 bp, Artificial Sequence
  Description of Artificial Sequence: Synthetic oligonucleotide
  5' Phos
cagagtccgatggagtccgatgga

SEQ ID NO: 777 - DNA, 24 bp, Artificial Sequence
  Description of Artificial Sequence: Synthetic oligonucleotide
  5' Phos
cagagtgtggaattgtgtggaatt

SEQ ID NO: 778 - DNA, 24 bp, Artificial Sequence
  Description of Artificial Sequence: Synthetic oligonucleotide
  5' Phos
cagagtgtggcagagtgtggcaga

SEQ ID NO: 779 - DNA, 24 bp, Artificial Sequence
  Description of Artificial Sequence: Synthetic oligonucleotide
  5' Phos
cagagttacggtgagttacggtga

SEQ ID NO: 780 - DNA, 24 bp, Artificial Sequence
  Description of Artificial Sequence: Synthetic oligonucleotide
  5' Phos
cagagttcgtacatgttcgtacat

SEQ ID NO: 781 - DNA, 24 bp, Artificial Sequence
  Description of Artificial Sequence: Synthetic oligonucleotide
  5' Phos
cagataaccggtaataaccggtaa

SEQ ID NO: 782 - DNA, 24 bp, Artificial Sequence
  Description of Artificial Sequence: Synthetic oligonucleotide
  5' Phos
cagatacagagtcatacagagtca

SEQ ID NO: 783 - DNA, 24 bp, Artificial Sequence
  Description of Artificial Sequence: Synthetic oligonucleotide
  5' Phos
cagataccgagatataccgagata

SEQ ID NO: 784 - DNA, 24 bp, Artificial Sequence
  Description of Artificial Sequence: Synthetic oligonucleotide
  5' Phos
cagatacgcatcgctacgcatcgc

SEQ ID NO: 785 - DNA, 24 bp, Artificial Sequence
  Description of Artificial Sequence: Synthetic oligonucleotide
  5' Phos
cagatacgcgcttgtacgcgcttg

SEQ ID NO: 786 - DNA, 24 bp, Artificial Sequence
  Description of Artificial Sequence: Synthetic oligonucleotide
  5' Phos
cagatagacttcactagacttcac

SEQ ID NO: 787 - DNA, 24 bp, Artificial Sequence
  Description of Artificial Sequence: Synthetic oligonucleotide
  5' Phos
cagatatcgcttagtatcgcttag

SEQ ID NO: 788 - DNA, 24 bp, Artificial Sequence
  Description of Artificial Sequence: Synthetic oligonucleotide
  5' Phos
cagatcacgatccgtcacgatccg

SEQ ID NO: 789 - DNA, 24 bp, Artificial Sequence
  Description of Artificial Sequence: Synthetic oligonucleotide
  5' Phos
cagatcagcttcgctcagcttcgc

SEQ ID NO: 790 - DNA, 24 bp, Artificial Sequence
  Description of Artificial Sequence: Synthetic oligonucleotide
  5' Phos
cagatccggacttctccggacttc

SEQ ID NO: 791 - DNA, 24 bp, Artificial Sequence
  Description of Artificial Sequence: Synthetic oligonucleotide
  5' Phos
cagatccggtatggtccggtatgg

SEQ ID NO: 792 - DNA, 24 bp, Artificial Sequence
  Description of Artificial Sequence: Synthetic oligonucleotide
  5' Phos
cagatccgtggtgatccgtggtga

SEQ ID NO: 793 - DNA, 24 bp, Artificial Sequence
  Description of Artificial Sequence: Synthetic oligonucleotide
  5' Phos
cagatcctcatccatcctcatcca

SEQ ID NO: 794 - DNA, 24 bp, Artificial Sequence
  Description of Artificial Sequence: Synthetic oligonucleotide
  5' Phos
cagatccttctggatccttctgga

SEQ ID NO: 795 - DNA, 24 bp, Artificial Sequence
  Description of Artificial Sequence: Synthetic oligonucleotide
  5' Phos
cagatcgctgttgctcgctgttgc

SEQ ID NO: 796 - DNA, 24 bp, Artificial Sequence
  Description of Artificial Sequence: Synthetic oligonucleotide
  5' Phos
cagatcggagcttgtcggagcttg

SEQ ID NO: 797 - DNA, 24 bp, Artificial Sequence
  Description of Artificial Sequence: Synthetic oligonucleotide
  5' Phos
cagatcggcatgagtcggcatgag

SEQ ID NO: 798 - DNA, 24 bp, Artificial Sequence
  Description of Artificial Sequence: Synthetic oligonucleotide
  5' Phos
cagatcggtggaactcggtggaac

SEQ ID NO: 799 - DNA, 24 bp, Artificial Sequence
  Description of Artificial Sequence: Synthetic oligonucleotide
  5' Phos
cagatcggttgtaatcggttgtaa

SEQ ID NO: 800 - DNA, 24 bp, Artificial Sequence
  Description of Artificial Sequence: Synthetic oligonucleotide
  5' Phos
cagatcgtgtggcatcgtgtggca

SEQ ID NO: 801 - DNA, 24 bp, Artificial Sequence
  Description of Artificial Sequence: Synthetic oligonucleotide
  5' Phos
cagatctgttccgctctgttccgc

SEQ ID NO: 802 - DNA, 24 bp, Artificial Sequence
  Description of Artificial Sequence: Synthetic oligonucleotide
  5' Phos
cagatcttggcgtctcttggcgtc

SEQ ID NO: 803 - DNA, 24 bp, Artificial Sequence
  Description of Artificial Sequence: Synthetic oligonucleotide
  5' Phos
cagatgattgagtctgattgagtc

SEQ ID NO: 804 - DNA, 24 bp, Artificial Sequence
  Description of Artificial Sequence: Synthetic oligonucleotide
  5' Phos
cagatgcgttggcatgcgttggca

SEQ ID NO: 805 - DNA, 24 bp, Artificial Sequence
  Description of Artificial Sequence: Synthetic oligonucleotide
  5' Phos
cagatggacatgcgtggacatgcg

SEQ ID NO: 806 - DNA, 24 bp, Artificial Sequence
  Description of Artificial Sequence: Synthetic oligonucleotide
  5' Phos
cagatggcaagccatggcaagcca

SEQ ID NO: 807 - DNA, 24 bp, Artificial Sequence
  Description of Artificial Sequence: Synthetic oligonucleotide
  5' Phos
cagatggttaactgtggttaactg

SEQ ID NO: 808 - DNA, 24 bp, Artificial Sequence
  Description of Artificial Sequence: Synthetic oligonucleotide
  5' Phos
cagatgtacctgagtgtacctgag

SEQ ID NO: 809 - DNA, 24 bp, Artificial Sequence
  Description of Artificial Sequence: Synthetic oligonucleotide
  5' Phos
cagatgtactacagtgtactacag

SEQ ID NO: 810 - DNA, 24 bp, Artificial Sequence
  Description of Artificial Sequence: Synthetic oligonucleotide
  5' Phos
cagatgtcggttgctgtcggttgc

SEQ ID NO: 811 - DNA, 24 bp, Artificial Sequence
  Description of Artificial Sequence: Synthetic oligonucleotide
  5' Phos
cagatgtctgtcggtgtctgtcgg

SEQ ID NO: 812 - DNA, 24 bp, Artificial Sequence
  Description of Artificial Sequence: Synthetic oligonucleotide
  5' Phos
cagatgtgactatctgtgactatc

SEQ ID NO: 813 - DNA, 24 bp, Artificial Sequence
  Description of Artificial Sequence: Synthetic oligonucleotide
  5' Phos
cagatgtgagtgcgtgtgagtgcg

SEQ ID NO: 814 - DNA, 24 bp, Artificial Sequence
  Description of Artificial Sequence: Synthetic oligonucleotide
  5' Phos
cagatgtggttcgctgtggttcgc

SEQ ID NO: 815 - DNA, 24 bp, Artificial Sequence
  Description of Artificial Sequence: Synthetic oligonucleotide
  5' Phos
cagatgttctctactgttctctac

SEQ ID NO: 816 - DNA, 24 bp, Artificial Sequence
  Description of Artificial Sequence: Synthetic oligonucleotide
  5' Phos
cagattagccagtcttagccagtc

SEQ ID NO: 817 - DNA, 24 bp, Artificial Sequence
  Description of Artificial Sequence: Synthetic oligonucleotide
  5' Phos
cagattcgcgaatattcgcgaata

SEQ ID NO: 818 - DNA, 24 bp, Artificial Sequence
  Description of Artificial Sequence: Synthetic oligonucleotide
  5' Phos
cagattcgcggtacttcgcggtac

SEQ ID NO: 819 - DNA, 24 bp, Artificial Sequence
  Description of Artificial Sequence: Synthetic oligonucleotide
  5' Phos
cagattctatgcagttctatgcag

SEQ ID NO: 820 - DNA, 24 bp, Artificial Sequence
  Description of Artificial Sequence: Synthetic oligonucleotide
  5' Phos
cagattcttaccgattcttaccga

SEQ ID NO: 821 - DNA, 24 bp, Artificial Sequence
  Description of Artificial Sequence: Synthetic oligonucleotide
  5' Phos
cagattgctctggattgctctgga

SEQ ID NO: 822 - DNA, 24 bp, Artificial Sequence
  Description of Artificial Sequence: Synthetic oligonucleotide
  5' Phos
cagattgtaacaccttgtaacacc

SEQ ID NO: 823 - DNA, 24 bp, Artificial Sequence
  Description of Artificial Sequence: Synthetic oligonucleotide
  5' Phos
cagaaacaagttccaacaagttcc

SEQ ID NO: 824 - DNA, 24 bp, Artificial Sequence
  Description of Artificial Sequence: Synthetic oligonucleotide
  5' Phos
cagaaacagcacgcaacagcacgc

SEQ ID NO: 825 - DNA, 24 bp, Artificial Sequence
  Description of Artificial Sequence: Synthetic oligonucleotide
  5' Phos
cagaaacgtgcggtaacgtgcggt

SEQ ID NO: 826 - DNA, 24 bp, Artificial Sequence
  Description of Artificial Sequence: Synthetic oligonucleotide
  5' Phos
cagaaagagcgatgaagagcgatg

SEQ ID NO: 827 - DNA, 24 bp, Artificial Sequence
  Description of Artificial Sequence: Synthetic oligonucleotide
  5' Phos
cagaaaggaattccaaggaattcc

SEQ ID NO: 828 - DNA, 24 bp, Artificial Sequence
  Description of Artificial Sequence: Synthetic oligonucleotide
  5' Phos
cagaaagtgaggcgaagtgaggcg

SEQ ID NO: 829 - DNA, 24 bp, Artificial Sequence
  Description of Artificial Sequence: Synthetic oligonucleotide
  5' Phos
cagaaatacgcgataatacgcgat

SEQ ID NO: 830 - DNA, 24 bp, Artificial Sequence
  Description of Artificial Sequence: Synthetic oligonucleotide
  5' Phos
cagaaataggttggaataggttgg

SEQ ID NO: 831 - DNA, 24 bp, Artificial Sequence
  Description of Artificial Sequence: Synthetic oligonucleotide
  5' Phos
cagaaatcgaagctaatcgaagct

SEQ ID NO: 832 - DNA, 24 bp, Artificial Sequence
  Description of Artificial Sequence: Synthetic oligonucleotide
  5' Phos
cagaacactacgatacactacgat

SEQ ID NO: 833 - DNA, 24 bp, Artificial Sequence
  Description of Artificial Sequence: Synthetic oligonucleotide
  5' Phos
cagaacactcagccacactcagcc

SEQ ID NO: 834 - DNA, 24 bp, Artificial Sequence
  Description of Artificial Sequence: Synthetic oligonucleotide
  5' Phos
cagaacatcgagccacatcgagcc

SEQ ID NO: 835 - DNA, 24 bp, Artificial Sequence
  Description of Artificial Sequence: Synthetic oligonucleotide
  5' Phos
cagaacattatgcgacattatgcg

SEQ ID NO: 836 - DNA, 24 bp, Artificial Sequence
  Description of Artificial Sequence: Synthetic oligonucleotide
  5' Phos
cagaaccagcaactaccagcaact

SEQ ID NO: 837 - DNA, 24 bp, Artificial Sequence
  Description of Artificial Sequence: Synthetic oligonucleotide
  5' Phos
cagaaccgaacacgaccgaacacg

SEQ ID NO: 838 - DNA, 24 bp, Artificial Sequence
  Description of Artificial Sequence: Synthetic oligonucleotide
  5' Phos
cagaaccgaacggtaccgaacggt

SEQ ID NO: 839 - DNA, 24 bp, Artificial Sequence
  Description of Artificial Sequence: Synthetic oligonucleotide
  5' Phos
cagaacgagtggctacgagtggct

SEQ ID NO: 840 - DNA, 24 bp, Artificial Sequence
  Description of Artificial Sequence: Synthetic oligonucleotide
  5' Phos
cagaacggttacggacggttacgg

SEQ ID NO: 841 - DNA, 24 bp, Artificial Sequence
  Description of Artificial Sequence: Synthetic oligonucleotide
  5' Phos
cagaacgtaagcgcacgtaagcgc

SEQ ID NO: 842 - DNA, 24 bp, Artificial Sequence
  Description of Artificial Sequence: Synthetic oligonucleotide
  5' Phos
cagaactatgtgctactatgtgct

SEQ ID NO: 843 - DNA, 24 bp, Artificial Sequence
  Description of Artificial Sequence: Synthetic oligonucleotide
  5' Phos
cagaactggagtccactggagtcc

SEQ ID NO: 844 - DNA, 24 bp, Artificial Sequence
  Description of Artificial Sequence: Synthetic oligonucleotide
  5' Phos
cagaactgtacttcactgtacttc

SEQ ID NO: 845 - DNA, 24 bp, Artificial Sequence
  Description of Artificial Sequence: Synthetic oligonucleotide
  5' Phos
cagaagaagtctgcagaagtctgc

SEQ ID NO: 846 - DNA, 24 bp, Artificial Sequence
  Description of Artificial Sequence: Synthetic oligonucleotide
  5' Phos
cagaagacgcgagtagacgcgagt

SEQ ID NO: 847 - DNA, 24 bp, Artificial Sequence
  Description of Artificial Sequence: Synthetic oligonucleotide
  5' Phos
cagaagactgtgctagactgtgct

SEQ ID NO: 848 - DNA, 24 bp, Artificial Sequence
  Description of Artificial Sequence: Synthetic oligonucleotide
  5' Phos
cagaagagtacgccagagtacgcc

SEQ ID NO: 849 - DNA, 24 bp, Artificial Sequence
  Description of Artificial Sequence: Synthetic oligonucleotide
  5' Phos
cagaagatcgactgagatcgactg

SEQ ID NO: 850 - DNA, 24 bp, Artificial Sequence
  Description of Artificial Sequence: Synthetic oligonucleotide
  5' Phos
cagaagattcggccagattcggcc

SEQ ID NO: 851 - DNA, 24 bp, Artificial Sequence
  Description of Artificial Sequence: Synthetic oligonucleotide
  5' Phos
cagaagcaagtgctagcaagtgct

SEQ ID NO: 852 - DNA, 24 bp, Artificial Sequence
  Description of Artificial Sequence: Synthetic oligonucleotide
  5' Phos
cagaagccattgcgagccattgcg

SEQ ID NO: 853 - DNA, 24 bp, Artificial Sequence
  Description of Artificial Sequence: Synthetic oligonucleotide
  5' Phos
cagaagcggacagtagcggacagt

SEQ ID NO: 854 - DNA, 24 bp, Artificial Sequence
  Description of Artificial Sequence: Synthetic oligonucleotide
  5' Phos
cagaagcgtaagcgagcgtaagcg

SEQ ID NO: 855 - DNA, 24 bp, Artificial Sequence
  Description of Artificial Sequence: Synthetic oligonucleotide
  5' Phos
cagaagctattctcagctattctc

SEQ ID NO: 856 - DNA, 24 bp, Artificial Sequence
  Description of Artificial Sequence: Synthetic oligonucleotide
  5' Phos
cagaagcttatacgagcttatacg

SEQ ID NO: 857 - DNA, 24 bp, Artificial Sequence
  Description of Artificial Sequence: Synthetic oligonucleotide
  5' Phos
cagaaggacagatgaggacagatg

SEQ ID NO: 858 - DNA, 24 bp, Artificial Sequence
  Description of Artificial Sequence: Synthetic oligonucleotide
  5' Phos
cagaaggatcagataggatcagat

SEQ ID NO: 859 - DNA, 24 bp, Artificial Sequence
  Description of Artificial Sequence: Synthetic oligonucleotide
  5' Phos
cagaaggctgaaggaggctgaagg

SEQ ID NO: 860 - DNA, 24 bp, Artificial Sequence
  Description of Artificial Sequence: Synthetic oligonucleotide
  5' Phos
cagaaggtacgaggaggtacgagg

SEQ ID NO: 861 - DNA, 24 bp, Artificial Sequence
  Description of Artificial Sequence: Synthetic oligonucleotide
  5' Phos
cagaaggtaggctcaggtaggctc

SEQ ID NO: 862 - DNA, 24 bp, Artificial Sequence
  Description of Artificial Sequence: Synthetic oligonucleotide
  5' Phos
cagaaggtgaacggaggtgaacgg

SEQ ID NO: 863 - DNA, 24 bp, Artificial Sequence
  Description of Artificial Sequence: Synthetic oligonucleotide
  5' Phos
cagaaggtgccaataggtgccaat

SEQ ID NO: 864 - DNA, 24 bp, Artificial Sequence
  Description of Artificial Sequence: Synthetic oligonucleotide
  5' Phos
cagaaggttcaacgaggttcaacg

SEQ ID NO: 865 - DNA, 24 bp, Artificial Sequence
  Description of Artificial Sequence: Synthetic oligonucleotide
  5' Phos
cagaagtcactcgcagtcactcgc

SEQ ID NO: 866 - DNA, 24 bp, Artificial Sequence
  Description of Artificial Sequence: Synthetic oligonucleotide
  5' Phos
cagaagtcgtggtgagtcgtggtg

SEQ ID NO: 867 - DNA, 24 bp, Artificial Sequence
  Description of Artificial Sequence: Synthetic oligonucleotide
  5' Phos
cagaagtggaggagagtggaggag

SEQ ID NO: 868 - DNA, 24 bp, Artificial Sequence
  Description of Artificial Sequence: Synthetic oligonucleotide
  5' Phos
cagaagttgagcgcagttgagcgc

SEQ ID NO: 869 - DNA, 24 bp, Artificial Sequence
  Description of Artificial Sequence: Synthetic oligonucleotide
  5' Phos
cagaagttgatggtagttgatggt

SEQ ID NO: 870 - DNA, 24 bp, Artificial Sequence
  Description of Artificial Sequence: Synthetic oligonucleotide
  5' Phos
cagaataacacagcataacacagc

SEQ ID NO: 871 - DNA, 24 bp, Artificial Sequence
  Description of Artificial Sequence: Synthetic oligonucleotide
  5' Phos
cagaataaggtccgataaggtccg

SEQ ID NO: 872 - DNA, 24 bp, Artificial Sequence
  Description of Artificial Sequence: Synthetic oligonucleotide
  5' Phos
cagaatacagtcagatacagtcag

SEQ ID NO: 873 - DNA, 24 bp, Artificial Sequence
  Description of Artificial Sequence: Synthetic oligonucleotide
  5' Phos
cagaataccggcctataccggcct

SEQ ID NO: 874 - DNA, 24 bp, Artificial Sequence
  Description of Artificial Sequence: Synthetic oligonucleotide
  5' Phos
cagaatagcaggatatagcaggat

SEQ ID NO: 875 - DNA, 24 bp, Artificial Sequence
  Description of Artificial Sequence: Synthetic oligonucleotide
  5' Phos
cagaatagcgttacatagcgttac

SEQ ID NO: 876 - DNA, 24 bp, Artificial Sequence
  Description of Artificial Sequence: Synthetic oligonucleotide
  5' Phos
cagaatagtccaacatagtccaac

SEQ ID NO: 877 - DNA, 24 bp, Artificial Sequence
  Description of Artificial Sequence: Synthetic oligonucleotide
  5' Phos
cagaatatcggcggatatcggcgg

SEQ ID NO: 878 - DNA, 24 bp, Artificial Sequence
  Description of Artificial Sequence: Synthetic oligonucleotide
  5' Phos
cagaatccgtgatgatccgtgatg

SEQ ID NO: 879 - DNA, 24 bp, Artificial Sequence
  Description of Artificial Sequence: Synthetic oligonucleotide
  5' Phos
cagaatcgtaccggatcgtaccgg

SEQ ID NO: 880 - DNA, 24 bp, Artificial Sequence
  Description of Artificial Sequence: Synthetic oligonucleotide
  5' Phos
cagaatcgttactgatcgttactg

SEQ ID NO: 881 - DNA, 24 bp, Artificial Sequence
  Description of Artificial Sequence: Synthetic oligonucleotide
  5' Phos
cagaatgaagatgcatgaagatgc

SEQ ID NO: 882 - DNA, 24 bp, Artificial Sequence
  Description of Artificial Sequence: Synthetic oligonucleotide
  5' Phos
cagaatggcgtggtatggcgtggt

SEQ ID NO: 883 - DNA, 24 bp, Artificial Sequence
  Description of Artificial Sequence: Synthetic oligonucleotide
  5' Phos
cagaatgttgagcgatgttgagcg

SEQ ID NO: 884 - DNA, 24 bp, Artificial Sequence
  Description of Artificial Sequence: Synthetic oligonucleotide
  5' Phos
cagaattagctgtcattagctgtc

SEQ ID NO: 885 - DNA, 24 bp, Artificial Sequence
  Description of Artificial Sequence: Synthetic oligonucleotide
  5' Phos
cagaattcgcgtgcattcgcgtgc

SEQ ID NO: 886 - DNA, 24 bp, Artificial Sequence
  Description of Artificial Sequence: Synthetic oligonucleotide
  5' Phos
cagaattgcgctccattgcgctcc

SEQ ID NO: 887 - DNA, 24 bp, Artificial Sequence
  Description of Artificial Sequence: Synthetic oligonucleotide
  5' Phos
cagaattgtgttgcattgtgttgc

SEQ ID NO: 888 - DNA, 24 bp, Artificial Sequence
  Description of Artificial Sequence: Synthetic oligonucleotide
  5' Phos
cagacaagacgaatcaagacgaat

SEQ ID NO: 889 - DNA, 24 bp, Artificial Sequence
  Description of Artificial Sequence: Synthetic oligonucleotide
  5' Phos
cagacacgcactgtcacgcactgt

SEQ ID NO: 890 - DNA, 24 bp, Artificial Sequence
  Description of Artificial Sequence: Synthetic oligonucleotide
  5' Phos
cagacacggagtagcacggagtag

SEQ ID NO: 891 - DNA, 24 bp, Artificial Sequence
  Description of Artificial Sequence: Synthetic oligonucleotide
  5' Phos
cagacacggtatcgcacggtatcg

SEQ ID NO: 892 - DNA, 24 bp, Artificial Sequence
  Description of Artificial Sequence: Synthetic oligonucleotide
  5' Phos
cagacactcggattcactcggatt

SEQ ID NO: 893 - DNA, 24 bp, Artificial Sequence
  Description of Artificial Sequence: Synthetic oligonucleotide
  5' Phos
cagacacttgagtacacttgagta

SEQ ID NO: 894 - DNA, 24 bp, Artificial Sequence
  Description of Artificial Sequence: Synthetic oligonucleotide
  5' Phos
cagacagcctcagtcagcctcagt

SEQ ID NO: 895 - DNA, 24 bp, Artificial Sequence
  Description of Artificial Sequence: Synthetic oligonucleotide
  5' Phos
cagacagctccaagcagctccaag

SEQ ID NO: 896 - DNA, 24 bp, Artificial Sequence
  Description of Artificial Sequence: Synthetic oligonucleotide
  5' Phos
cagacatcgaggagcatcgaggag

SEQ ID NO: 897 - DNA, 24 bp, Artificial Sequence
  Description of Artificial Sequence: Synthetic oligonucleotide
  5' Phos
cagacattggccgtcattggccgt

SEQ ID NO: 898 - DNA, 24 bp, Artificial Sequence
  Description of Artificial Sequence: Synthetic oligonucleotide
  5' Phos
cagaccagaactggccagaactgg

SEQ ID NO: 899 - DNA, 24 bp, Artificial Sequence
  Description of Artificial Sequence: Synthetic oligonucleotide
  5' Phos
cagaccagatacggccagatacgg

SEQ ID NO: 900 - DNA, 24 bp, Artificial Sequence
  Description of Artificial Sequence: Synthetic oligonucleotide
  5' Phos
cagaccaggatccaccaggatcca

SEQ ID NO: 901 - DNA, 24 bp, Artificial Sequence
  Description of Artificial Sequence: Synthetic oligonucleotide
  5' Phos
cagaccaggatgttccaggatgtt

SEQ ID NO: 902 - DNA, 24 bp, Artificial Sequence
  Description of Artificial Sequence: Synthetic oligonucleotide
  5' Phos
cagaccgagcatgtccgagcatgt

SEQ ID NO: 903 - DNA, 24 bp, Artificial Sequence
  Description of Artificial Sequence: Synthetic oligonucleotide
  5' Phos
cagaccggagtgttccggagtgtt

SEQ ID NO: 904 - DNA, 24 bp, Artificial Sequence
  Description of Artificial Sequence: Synthetic oligonucleotide
  5' Phos
cagaccggtaccatccggtaccat

SEQ ID NO: 905 - DNA, 24 bp, Artificial Sequence
  Description of Artificial Sequence: Synthetic oligonucleotide
  5' Phos
cagaccgtctaaggccgtctaagg

SEQ ID NO: 906 - DNA, 24 bp, Artificial Sequence
  Description of Artificial Sequence: Synthetic oligonucleotide
  5' Phos
cagacctccattaacctccattaa

SEQ ID NO: 907 - DNA, 24 bp, Artificial Sequence
  Description of Artificial Sequence: Synthetic oligonucleotide
  5' Phos
cagacctcctgactcctcctgact

SEQ ID NO: 908 - DNA, 24 bp, Artificial Sequence
  Description of Artificial Sequence: Synthetic oligonucleotide
  5' Phos
cagacctctgctctcctctgctct

SEQ ID NO: 909 - DNA, 24 bp, Artificial Sequence
  Description of Artificial Sequence: Synthetic oligonucleotide
  5' Phos
cagacctgccttgtcctgccttgt

SEQ ID NO: 910 - DNA, 24 bp, Artificial Sequence
  Description of Artificial Sequence: Synthetic oligonucleotide
  5' Phos
cagacctggccattcctggccatt

SEQ ID NO: 911 - DNA, 24 bp, Artificial Sequence
  Description of Artificial Sequence: Synthetic oligonucleotide
  5' Phos
cagaccttaacgcgccttaacgcg

SEQ ID NO: 912 - DNA, 24 bp, Artificial Sequence
  Description of Artificial Sequence: Synthetic oligonucleotide
  5' Phos
cagacgacctgtctcgacctgtct

SEQ ID NO: 913 - DNA, 24 bp, Artificial Sequence
  Description of Artificial Sequence: Synthetic oligonucleotide
  5' Phos
cagacgcgttacgtcgcgttacgt

SEQ ID NO: 914 - DNA, 24 bp, Artificial Sequence
  Description of Artificial Sequence: Synthetic oligonucleotide
  5' Phos
cagacggcagttcacggcagttca

SEQ ID NO: 915 - DNA, 24 bp, Artificial Sequence
  Description of Artificial Sequence: Synthetic oligonucleotide
  5' Phos
cagacggccattagcggccattag

SEQ ID NO: 916 - DNA, 24 bp, Artificial Sequence
  Description of Artificial Sequence: Synthetic oligonucleotide
  5' Phos
cagacgtattgcatcgtattgcat

SEQ ID NO: 917 - DNA, 24 bp, Artificial Sequence
  Description of Artificial Sequence: Synthetic oligonucleotide
  5' Phos
cagactacgaccgtctacgaccgt

SEQ ID NO: 918 - DNA, 24 bp, Artificial Sequence
  Description of Artificial Sequence: Synthetic oligonucleotide
  5' Phos
cagactaggaaggtctaggaaggt

SEQ ID NO: 919 - DNA, 24 bp, Artificial Sequence
  Description of Artificial Sequence: Synthetic oligonucleotide
  5' Phos
cagactagtcctgtctagtcctgt

SEQ ID NO: 920 - DNA, 24 bp, Artificial Sequence
  Description of Artificial Sequence: Synthetic oligonucleotide
  5' Phos
cagactagtggaggctagtggagg

SEQ ID NO: 921 - DNA, 24 bp, Artificial Sequence
  Description of Artificial Sequence: Synthetic oligonucleotide
  5' Phos
cagactcgcagagtctcgcagagt

SEQ ID NO: 922 - DNA, 24 bp, Artificial Sequence
  Description of Artificial Sequence: Synthetic oligonucleotide
  5' Phos
cagactcgcttcgtctcgcttcgt

SEQ ID NO: 923 - DNA, 24 bp, Artificial Sequence
  Description of Artificial Sequence: Synthetic oligonucleotide
  5' Phos
cagactcgttagcgctcgttagcg

SEQ ID NO: 924 - DNA, 24 bp, Artificial Sequence
  Description of Artificial Sequence: Synthetic oligonucleotide
  5' Phos
cagactcttccaagctcttccaag

SEQ ID NO: 925 - DNA, 24 bp, Artificial Sequence
  Description of Artificial Sequence: Synthetic oligonucleotide
  5' Phos
cagactgcttcaatctgcttcaat

SEQ ID NO: 926 - DNA, 24 bp, Artificial Sequence
  Description of Artificial Sequence: Synthetic oligonucleotide
  5' Phos
cagactggtatcaactggtatcaa

SEQ ID NO: 927 - DNA, 24 bp, Artificial Sequence
  Description of Artificial Sequence: Synthetic oligonucleotide
  5' Phos
cagactgtcttcggctgtcttcgg

SEQ ID NO: 928 - DNA, 24 bp, Artificial Sequence
  Description of Artificial Sequence: Synthetic oligonucleotide
  5' Phos
cagacttcatgacgcttcatgacg

SEQ ID NO: 929 - DNA, 24 bp, Artificial Sequence
  Description of Artificial Sequence: Synthetic oligonucleotide
  5' Phos
cagacttcggcagtcttcggcagt

SEQ ID NO: 930 - DNA, 24 bp, Artificial Sequence
  Description of Artificial Sequence: Synthetic oligonucleotide
  5' Phos
cagacttgaccggtcttgaccggt

SEQ ID NO: 931 - DNA, 24 bp, Artificial Sequence
  Description of Artificial Sequence: Synthetic oligonucleotide
  5' Phos
cagacttgcctattcttgcctatt

SEQ ID NO: 932 - DNA, 24 bp, Artificial Sequence
  Description of Artificial Sequence: Synthetic oligonucleotide
  5' Phos
cagagaacttgtgagaacttgtga

SEQ ID NO: 933 - DNA, 24 bp, Artificial Sequence
  Description of Artificial Sequence: Synthetic oligonucleotide
  5' Phos
cagagaagcattctgaagcattct

SEQ ID NO: 934 - DNA, 24 bp, Artificial Sequence
  Description of Artificial Sequence: Synthetic oligonucleotide
  5' Phos
cagagaatccattcgaatccattc

SEQ ID NO: 935 - DNA, 24 bp, Artificial Sequence
  Description of Artificial Sequence: Synthetic oligonucleotide
  5' Phos
cagagacgcctgttgacgcctgtt

SEQ ID NO: 936 - DNA, 24 bp, Artificial Sequence
  Description of Artificial Sequence: Synthetic oligonucleotide
  5' Phos
cagagacgtaggacgacgtaggac

SEQ ID NO: 937 - DNA, 24 bp, Artificial Sequence
  Description of Artificial Sequence: Synthetic oligonucleotide
  5' Phos
cagagactaatggtgactaatggt

SEQ ID NO: 938 - DNA, 24 bp, Artificial Sequence
  Description of Artificial Sequence: Synthetic oligonucleotide
  5' Phos
cagagagcctccttgagcctcctt

SEQ ID NO: 939 - DNA, 24 bp, Artificial Sequence
  Description of Artificial Sequence: Synthetic oligonucleotide
  5' Phos
cagagagcgtctacgagcgtctac

SEQ ID NO: 940 - DNA, 24 bp, Artificial Sequence
  Description of Artificial Sequence: Synthetic oligonucleotide
  5' Phos
cagagaggataggcgaggataggc

SEQ ID NO: 941 - DNA, 24 bp, Artificial Sequence
  Description of Artificial Sequence: Synthetic oligonucleotide
  5' Phos
cagagagtgccatcgagtgccatc

SEQ ID NO: 942 - DNA, 24 bp, Artificial Sequence
  Description of Artificial Sequence: Synthetic oligonucleotide
  5' Phos
cagagagtggatctgagtggatct

SEQ ID NO: 943 - DNA, 24 bp, Artificial Sequence
  Description of Artificial Sequence: Synthetic oligonucleotide
  5' Phos
cagagagtggtagcgagtggtagc

SEQ ID NO: 944 - DNA, 24 bp, Artificial Sequence
  Description of Artificial Sequence: Synthetic oligonucleotide
  5' Phos
cagagagttagagagagttagaga

SEQ ID NO: 945 - DNA, 24 bp, Artificial Sequence
  Description of Artificial Sequence: Synthetic oligonucleotide
  5' Phos
cagagcacatctgcgcacatctgc

SEQ ID NO: 946 - DNA, 24 bp, Artificial Sequence
  Description of Artificial Sequence: Synthetic oligonucleotide
  5' Phos
cagagcaccattacgcaccattac

SEQ ID NO: 947 - DNA, 24 bp, Artificial Sequence
  Description of Artificial Sequence: Synthetic oligonucleotide
  5' Phos
cagagcagcctattgcagcctatt

SEQ ID NO: 948 - DNA, 24 bp, Artificial Sequence
  Description of Artificial Sequence: Synthetic oligonucleotide
  5' Phos
cagagcagtatcaagcagtatcaa

SEQ ID NO: 949 - DNA, 24 bp, Artificial Sequence
  Description of Artificial Sequence: Synthetic oligonucleotide
  5' Phos
cagagccgtcgttagccgtcgtta

SEQ ID NO: 950 - DNA, 24 bp, Artificial Sequence
  Description of Artificial Sequence: Synthetic oligonucleotide
  5' Phos
cagagcctgagctagcctgagcta

SEQ ID NO: 951 - DNA, 24 bp, Artificial Sequence
  Description of Artificial Sequence: Synthetic oligonucleotide
  5' Phos
cagagcgcaagcaagcgcaagcaa

SEQ ID NO: 952 - DNA, 24 bp, Artificial Sequence
  Description of Artificial Sequence: Synthetic oligonucleotide
  5' Phos
cagagcgttacgacgcgttacgac

SEQ ID NO: 953 - DNA, 24 bp, Artificial Sequence
  Description of Artificial Sequence: Synthetic oligonucleotide
  5' Phos
cagagcgttggatcgcgttggatc

SEQ ID NO: 954 - DNA, 24 bp, Artificial Sequence
  Description of Artificial Sequence: Synthetic oligonucleotide
  5' Phos
cagagctagtcgcagctagtcgca

SEQ ID NO: 955 - DNA, 24 bp, Artificial Sequence
  Description of Artificial Sequence: Synthetic oligonucleotide
  5' Phos
cagagctcactaccgctcactacc

SEQ ID NO: 956 - DNA, 24 bp, Artificial Sequence
  Description of Artificial Sequence: Synthetic oligonucleotide
  5' Phos
cagagctcgaattagctcgaatta

SEQ ID NO: 957 - DNA, 24 bp, Artificial Sequence
  Description of Artificial Sequence: Synthetic oligonucleotide
  5' Phos
cagagctcgattccgctcgattcc

SEQ ID NO: 958 - DNA, 24 bp, Artificial Sequence
  Description of Artificial Sequence: Synthetic oligonucleotide
  5' Phos
cagagctgaggatcgctgaggatc

SEQ ID NO: 959 - DNA, 24 bp, Artificial Sequence
  Description of Artificial Sequence: Synthetic oligonucleotide
  5' Phos
cagagcttcattctgcttcattct

SEQ ID NO: 960 - DNA, 24 bp, Artificial Sequence
  Description of Artificial Sequence: Synthetic oligonucleotide
  5' Phos
cagagcttgctattgcttgctatt

SEQ ID NO: 961 - DNA, 24 bp, Artificial Sequence
  Description of Artificial Sequence: Synthetic oligonucleotide
  5' Phos
ttcggcttggttgcgcttggttgc

SEQ ID NO: 962 - DNA, 24 bp, Artificial Sequence
  Description of Artificial Sequence: Synthetic oligonucleotide
  5' Phos
ttcgggagtggttcggagtggttc

SEQ ID NO: 963 - DNA, 24 bp, Artificial Sequence
  Description of Artificial Sequence: Synthetic oligonucleotide
  5' Phos
ttcgggataataccggataatacc

SEQ ID NO: 964 - DNA, 24 bp, Artificial Sequence
  Description of Artificial Sequence: Synthetic oligonucleotide
  5' Phos
ttcgggatcgtggtggatcgtggt

SEQ ID NO: 965 - DNA, 24 bp, Artificial Sequence
  Description of Artificial Sequence: Synthetic oligonucleotide
  5' Phos
ttcgggatgattgtggatgattgt

SEQ ID NO: 966 - DNA, 24 bp, Artificial Sequence
  Description of Artificial Sequence: Synthetic oligonucleotide
  5' Phos
ttcgggatgcgttcggatgcgttc

SEQ ID NO: 967 - DNA, 24 bp, Artificial Sequence
  Description of Artificial Sequence: Synthetic oligonucleotide
  5' Phos
ttcgggcgaatgtcggcgaatgtc

SEQ ID NO: 968 - DNA, 24 bp, Artificial Sequence
  Description of Artificial Sequence: Synthetic oligonucleotide
  5' Phos
ttcgggcgattggtggcgattggt

SEQ ID NO: 969 - DNA, 24 bp, Artificial Sequence
  Description of Artificial Sequence: Synthetic oligonucleotide
  5' Phos
ttcgggcggtatcaggcggtatca

SEQ ID NO: 970 - DNA, 24 bp, Artificial Sequence
  Description of Artificial Sequence: Synthetic oligonucleotide
  5' Phos
ttcgggctatccacggctatccac

SEQ ID NO: 971 - DNA, 24 bp, Artificial Sequence
  Description of Artificial Sequence: Synthetic oligonucleotide
  5' Phos
ttcgggctattacaggctattaca

SEQ ID NO: 972 - DNA, 24 bp, Artificial Sequence
  Description of Artificial Sequence: Synthetic oligonucleotide
  5' Phos
ttcgggctgaactcggctgaactc

SEQ ID NO: 973 - DNA, 24 bp, Artificial Sequence
  Description of Artificial Sequence: Synthetic oligonucleotide
  5' Phos
ttcgggtacagtcaggtacagtca

SEQ ID NO: 974 - DNA, 24 bp, Artificial Sequence
  Description of Artificial Sequence: Synthetic oligonucleotide
  5' Phos
ttcgggtcgaacctggtcgaacct

SEQ ID NO: 975 - DNA, 24 bp, Artificial Sequence
  Description of Artificial Sequence: Synthetic oligonucleotide
  5' Phos
ttcgggtctctcgtggtctctcgt

SEQ ID NO: 976 - DNA, 24 bp, Artificial Sequence
  Description of Artificial Sequence: Synthetic oligonucleotide
  5' Phos
ttcgggtgcttgtcggtgcttgtc

SEQ ID NO: 977 - DNA, 24 bp, Artificial Sequence
  Description of Artificial Sequence: Synthetic oligonucleotide
  5' Phos
ttcgggttccacttggttccactt

SEQ ID NO: 978 - DNA, 24 bp, Artificial Sequence
  Description of Artificial Sequence: Synthetic oligonucleotide
  5' Phos
ttcgggttgcatccggttgcatcc

SEQ ID NO: 979 - DNA, 24 bp, Artificial Sequence
  Description of Artificial Sequence: Synthetic oligonucleotide
  5' Phos
ttcgggttggacgtggttggacgt

SEQ ID NO: 980 - DNA, 24 bp, Artificial Sequence
  Description of Artificial Sequence: Synthetic oligonucleotide
  5' Phos
ttcggtaagagcaagtaagagcaa

SEQ ID NO: 981 - DNA, 24 bp, Artificial Sequence
  Description of Artificial Sequence: Synthetic oligonucleotide
  5' Phos
ttcggtaaggcttagtaaggctta

SEQ ID NO: 982 - DNA, 24 bp, Artificial Sequence
  Description of Artificial Sequence: Synthetic oligonucleotide
  5' Phos
ttcggtagtcctcagtagtcctca

SEQ ID NO: 983 - DNA, 24 bp, Artificial Sequence
  Description of Artificial Sequence: Synthetic oligonucleotide
  5' Phos
ttcggtccggttctgtccggttct

SEQ ID NO: 984 - DNA, 24 bp, Artificial Sequence
  Description of Artificial Sequence: Synthetic oligonucleotide
  5' Phos
ttcggtcctacagcgtcctacagc

SEQ ID NO: 985 - DNA, 24 bp, Artificial Sequence
  Description of Artificial Sequence: Synthetic oligonucleotide
  5' Phos
ttcggtcggattaagtcggattaa

SEQ ID NO: 986 - DNA, 24 bp, Artificial Sequence
  Description of Artificial Sequence: Synthetic oligonucleotide
  5' Phos
ttcggtgaacagaagtgaacagaa

SEQ ID NO: 987 - DNA, 24 bp, Artificial Sequence
  Description of Artificial Sequence: Synthetic oligonucleotide
  5' Phos
ttcggtgcctacacgtgcctacac

SEQ ID NO: 988 - DNA, 24 bp, Artificial Sequence
  Description of Artificial Sequence: Synthetic oligonucleotide
  5' Phos
ttcggtgtatcggagtgtatcgga

SEQ ID NO: 989 - DNA, 24 bp, Artificial Sequence
  Description of Artificial Sequence: Synthetic oligonucleotide
  5' Phos
ttcggtgtccatgagtgtccatga

SEQ ID NO: 990 - DNA, 24 bp, Artificial Sequence
  Description of Artificial Sequence: Synthetic oligonucleotide
  5' Phos
ttcggtgtctaatcgtgtctaatc

SEQ ID NO: 991 - DNA, 24 bp, Artificial Sequence
  Description of Artificial Sequence: Synthetic oligonucleotide
  5' Phos
ttcggtgttcctgcgtgttcctgc

SEQ ID NO: 992 - DNA, 24 bp, Artificial Sequence
  Description of Artificial Sequence: Synthetic oligonucleotide
  5' Phos
ttcggtgttctgctgtgttctgct

SEQ ID NO: 993 - DNA, 24 bp, Artificial Sequence
  Description of Artificial Sequence: Synthetic oligonucleotide
  5' Phos
ttcggttaagaggagttaagagga

SEQ ID NO: 994 - DNA, 24 bp, Artificial Sequence
  Description of Artificial Sequence: Synthetic oligonucleotide
  5' Phos
ttcggttaatgcgtgttaatgcgt

SEQ ID NO: 995 - DNA, 24 bp, Artificial Sequence
  Description of Artificial Sequence: Synthetic oligonucleotide
  5' Phos
ttcggttaggctgtgttaggctgt

SEQ ID NO: 996 - DNA, 24 bp, Artificial Sequence
  Description of Artificial Sequence: Synthetic oligonucleotide
  5' Phos
ttcggttcattggagttcattgga

SEQ ID NO: 997 - DNA, 24 bp, Artificial Sequence
  Description of Artificial Sequence: Synthetic oligonucleotide
  5' Phos
ttcggttcggaccagttcggacca

SEQ ID NO: 998 - DNA, 24 bp, Artificial Sequence
  Description of Artificial Sequence: Synthetic oligonucleotide
  5' Phos
ttcggttggccagtgttggccagt

SEQ ID NO: 999 - DNA, 24 bp, Artificial Sequence
  Description of Artificial Sequence: Synthetic oligonucleotide
  5' Phos
ttcggttggtagttgttggtagtt

SEQ ID NO: 1000 - DNA, 24 bp, Artificial Sequence
  Description of Artificial Sequence: Synthetic oligonucleotide
  5' Phos
ttcgtaacacgacataacacgaca

SEQ ID NO: 1001 - DNA, 24 bp, Artificial Sequence
  Description of Artificial Sequence: Synthetic oligonucleotide
  5' Phos
ttcgtaagagagcataagagagca

SEQ ID NO: 1002 - DNA, 24 bp, Artificial Sequence
  Description of Artificial Sequence: Synthetic oligonucleotide
  5' Phos
ttcgtaagaggcggtaagaggcgg

SEQ ID NO: 1003 - DNA, 24 bp, Artificial Sequence
  Description of Artificial Sequence: Synthetic oligonucleotide
  5' Phos
ttcgtaaggaatggtaaggaatgg

SEQ ID NO: 1004 - DNA, 24 bp, Artificial Sequence
  Description of Artificial Sequence: Synthetic oligonucleotide
  5' Phos
ttcgtaatgagcactaatgagcac

SEQ ID NO: 1005 - DNA, 24 bp, Artificial Sequence
  Description of Artificial Sequence: Synthetic oligonucleotide
  5' Phos
ttcgtacactggtctacactggtc

SEQ ID NO: 1006 - DNA, 24 bp, Artificial Sequence
  Description of Artificial Sequence: Synthetic oligonucleotide
  5' Phos
ttcgtacagcgcaatacagcgcaa

SEQ ID NO: 1007 - DNA, 24 bp, Artificial Sequence
  Description of Artificial Sequence: Synthetic oligonucleotide
  5' Phos
ttcgtacaggttagtacaggttag

SEQ ID NO: 1008 - DNA, 24 bp, Artificial Sequence
  Description of Artificial Sequence: Synthetic oligonucleotide
  5' Phos
ttcgtacattaccgtacattaccg

SEQ ID NO: 1009 - DNA, 24 bp, Artificial Sequence
  Description of Artificial Sequence: Synthetic oligonucleotide
  5' Phos
ttcgtaccaatctctaccaatctc

SEQ ID NO: 1010 - DNA, 24 bp, Artificial Sequence
  Description of Artificial Sequence: Synthetic oligonucleotide
  5' Phos
ttcgtaccggagagtaccggagag

SEQ ID NO: 1011 - DNA, 24 bp, Artificial Sequence
  Description of Artificial Sequence: Synthetic oligonucleotide
  5' Phos
ttcgtaccggcttctaccggcttc

SEQ ID NO: 1012 - DNA, 24 bp, Artificial Sequence
  Description of Artificial Sequence: Synthetic oligonucleotide
  5' Phos
ttcgtacctacatgtacctacatg

SEQ ID NO: 1013 - DNA, 24 bp, Artificial Sequence
  Description of Artificial Sequence: Synthetic oligonucleotide
  5' Phos
ttcgtacgattacgtacgattacg

SEQ ID NO: 1014 - DNA, 24 bp, Artificial Sequence
  Description of Artificial Sequence: Synthetic oligonucleotide
  5' Phos
ttcgtacgcagaggtacgcagagg

SEQ ID NO: 1015 - DNA, 24 bp, Artificial Sequence
  Description of Artificial Sequence: Synthetic oligonucleotide
  5' Phos
ttcgtactcaacgatactcaacga

SEQ ID NO: 1016 - DNA, 24 bp, Artificial Sequence
  Description of Artificial Sequence: Synthetic oligonucleotide
  5' Phos
ttcgtagaccaacctagaccaacc

SEQ ID NO: 1017 - DNA, 24 bp, Artificial Sequence
  Description of Artificial Sequence: Synthetic oligonucleotide
  5' Phos
ttcgtagacctccgtagacctccg

SEQ ID NO: 1018 - DNA, 24 bp, Artificial Sequence
  Description of Artificial Sequence: Synthetic oligonucleotide
  5' Phos
ttcgtagcagttgatagcagttga

SEQ ID NO: 1019 - DNA, 24 bp, Artificial Sequence
  Description of Artificial Sequence: Synthetic oligonucleotide
  5' Phos
ttcgtagcgcaagctagcgcaagc

SEQ ID NO: 1020 - DNA, 24 bp, Artificial Sequence
  Description of Artificial Sequence: Synthetic oligonucleotide
  5' Phos
ttcgtagctatacctagctatacc

SEQ ID NO: 1021 - DNA, 24 bp, Artificial Sequence
  Description of Artificial Sequence: Synthetic oligonucleotide
  5' Phos
ttcgtagcttgcgctagcttgcgc

SEQ ID NO: 1022 - DNA, 24 bp, Artificial Sequence
  Description of Artificial Sequence: Synthetic oligonucleotide
  5' Phos
ttcgtaggaatccataggaatcca

SEQ ID NO: 1023 - DNA, 24 bp, Artificial Sequence
  Description of Artificial Sequence: Synthetic oligonucleotide
  5' Phos
ttcgtaggccgttctaggccgttc

SEQ ID NO: 1024 - DNA, 24 bp, Artificial Sequence
  Description of Artificial Sequence: Synthetic oligonucleotide
  5' Phos
ttcgtaggtcactataggtcacta

SEQ ID NO: 1025 - DNA, 24 bp, Artificial Sequence
  Description of Artificial Sequence: Synthetic oligonucleotide
  5' Phos
ttcgtagtcgcgtctagtcgcgtc

SEQ ID NO: 1026 - DNA, 24 bp, Artificial Sequence
  Description of Artificial Sequence: Synthetic oligonucleotide
  5' Phos
ttcgtatacggctatatacggcta

SEQ ID NO: 1027 - DNA, 24 bp, Artificial Sequence
  Description of Artificial Sequence: Synthetic oligonucleotide
  5' Phos
ttcgtatcgcggcatatcgcggca

SEQ ID NO: 1028 - DNA, 24 bp, Artificial Sequence
  Description of Artificial Sequence: Synthetic oligonucleotide
  5' Phos
ttcgtatggagcaatatggagcaa

SEQ ID NO: 1029 - DNA, 24 bp, Artificial Sequence
  Description of Artificial Sequence: Synthetic oligonucleotide
  5' Phos
ttcgtatggcgtggtatggcgtgg

SEQ ID NO: 1030 - DNA, 24 bp, Artificial Sequence
  Description of Artificial Sequence: Synthetic oligonucleotide
  5' Phos
ttcgtatgttcaggtatgttcagg

SEQ ID NO: 1031 - DNA, 24 bp, Artificial Sequence
  Description of Artificial Sequence: Synthetic oligonucleotide
  5' Phos
ttcgtattcctgtctattcctgtc

SEQ ID NO: 1032 - DNA, 24 bp, Artificial Sequence
  Description of Artificial Sequence: Synthetic oligonucleotide
  5' Phos
ttcgtcaagagatctcaagagatc

SEQ ID NO: 1033 - DNA, 24 bp, Artificial Sequence
  Description of Artificial Sequence: Synthetic oligonucleotide
  5' Phos
ttcgtcactaccaatcactaccaa

SEQ ID NO: 1034 - DNA, 24 bp, Artificial Sequence
  Description of Artificial Sequence: Synthetic oligonucleotide
  5' Phos
ttcgtcagtctgcgtcagtctgcg

SEQ ID NO: 1035 - DNA, 24 bp, Artificial Sequence
  Description of Artificial Sequence: Synthetic oligonucleotide
  5' Phos
ttcgtcagttaagctcagttaagc

SEQ ID NO: 1036 - DNA, 24 bp, Artificial Sequence
  Description of Artificial Sequence: Synthetic oligonucleotide
  5' Phos
ttcgtccagagtggtccagagtgg

SEQ ID NO: 1037 - DNA, 24 bp, Artificial Sequence
  Description of Artificial Sequence: Synthetic oligonucleotide
  5' Phos
ttcgtccagtcgtctccagtcgtc

SEQ ID NO: 1038 - DNA, 24 bp, Artificial Sequence
  Description of Artificial Sequence: Synthetic oligonucleotide
  5' Phos
ttcgtccgacgttgtccgacgttg

SEQ ID NO: 1039 - DNA, 24 bp, Artificial Sequence
  Description of Artificial Sequence: Synthetic oligonucleotide
  5' Phos
ttcgtcctaccgactcctaccgac

SEQ ID NO: 1040 - DNA, 24 bp, Artificial Sequence
  Description of Artificial Sequence: Synthetic oligonucleotide
  5' Phos
ttcgtccttcctcctccttcctcc

SEQ ID NO: 1041 - DNA, 24 bp, Artificial Sequence
  Description of Artificial Sequence: Synthetic oligonucleotide
  5' Phos
ttcgtcgagagccatcgagagcca

SEQ ID NO: 1042 - DNA, 24 bp, Artificial Sequence
  Description of Artificial Sequence: Synthetic oligonucleotide
  5' Phos
ttcgtcgcacagactcgcacagac

SEQ ID NO: 1043 - DNA, 24 bp, Artificial Sequence
  Description of Artificial Sequence: Synthetic oligonucleotide
  5' Phos
ttcgtcgccgttagtcgccgttag

SEQ ID NO: 1044 - DNA, 24 bp, Artificial Sequence
  Description of Artificial Sequence: Synthetic oligonucleotide
  5' Phos
ttcgtcggcacaactcggcacaac

SEQ ID NO: 1045 - DNA, 24 bp, Artificial Sequence
  Description of Artificial Sequence: Synthetic oligonucleotide
  5' Phos
ttcgtcggcagttgtcggcagttg

SEQ ID NO: 1046 - DNA, 24 bp, Artificial Sequence
  Description of Artificial Sequence: Synthetic oligonucleotide
  5' Phos
ttcgtcggtcacactcggtcacac

SEQ ID NO: 1047 - DNA, 24 bp, Artificial Sequence
  Description of Artificial Sequence: Synthetic oligonucleotide
  5' Phos
ttcgtcgtgctagctcgtgctagc

SEQ ID NO: 1048 - DNA, 24 bp, Artificial Sequence
  Description of Artificial Sequence: Synthetic oligonucleotide
  5' Phos
ttcgtctagcctaatctagcctaa

SEQ ID NO: 1049 - DNA, 24 bp, Artificial Sequence
  Description of Artificial Sequence: Synthetic oligonucleotide
  5' Phos
ttcgtctcactgcgtctcactgcg

SEQ ID NO: 1050 - DNA, 24 bp, Artificial Sequence
  Description of Artificial Sequence: Synthetic oligonucleotide
  5' Phos
ttcgtctccggcaatctccggcaa

SEQ ID NO: 1051 - DNA, 24 bp, Artificial Sequence
  Description of Artificial Sequence: Synthetic oligonucleotide
  5' Phos
ttcgtctcgctctctctcgctctc

SEQ ID NO: 1052 - DNA, 24 bp, Artificial Sequence
  Description of Artificial Sequence: Synthetic oligonucleotide
  5' Phos
ttcgtctgtcgcaatctgtcgcaa

SEQ ID NO: 1053 - DNA, 24 bp, Artificial Sequence
  Description of Artificial Sequence: Synthetic oligonucleotide
  5' Phos
ttcgtcttaacctctcttaacctc

SEQ ID NO: 1054 - DNA, 24 bp, Artificial Sequence
  Description of Artificial Sequence: Synthetic oligonucleotide
  5' Phos
ttcgtgacacatgatgacacatga

SEQ ID NO: 1055 - DNA, 24 bp, Artificial Sequence
  Description of Artificial Sequence: Synthetic oligonucleotide
  5' Phos
ttcgtgagagtgaatgagagtgaa

SEQ ID NO: 1056 - DNA, 24 bp, Artificial Sequence
  Description of Artificial Sequence: Synthetic oligonucleotide
  5' Phos
ttcgtgagtggctgtgagtggctg

SEQ ID NO: 1057 - DNA, 24 bp, Artificial Sequence
  Description of Artificial Sequence: Synthetic oligonucleotide
  5' Phos
ttcgtgattgaccatgattgacca

SEQ ID NO: 1058 - DNA, 24 bp, Artificial Sequence
  Description of Artificial Sequence: Synthetic oligonucleotide
  5' Phos
ttcgtgcagtcgcatgcagtcgca

SEQ ID NO: 1059 - DNA, 24 bp, Artificial Sequence
  Description of Artificial Sequence: Synthetic oligonucleotide
  5' Phos
ttcgtgccatgaggtgccatgagg

SEQ ID NO: 1060 - DNA, 24 bp, Artificial Sequence
  Description of Artificial Sequence: Synthetic oligonucleotide
  5' Phos
ttcgtgcctaacgctgcctaacgc

SEQ ID NO: 1061 - DNA, 24 bp, Artificial Sequence
  Description of Artificial Sequence: Synthetic oligonucleotide
  5' Phos
ttcgtgcctataactgcctataac

SEQ ID NO: 1062 - DNA, 24 bp, Artificial Sequence
  Description of Artificial Sequence: Synthetic oligonucleotide
  5' Phos
ttcgtgcgagagagtgcgagagag

SEQ ID NO: 1063 - DNA, 24 bp, Artificial Sequence
  Description of Artificial Sequence: Synthetic oligonucleotide
  5' Phos
ttcgtgcgcgatcatgcgcgatca

SEQ ID NO: 1064 - DNA, 24 bp, Artificial Sequence
  Description of Artificial Sequence: Synthetic oligonucleotide
  5' Phos
ttcgtgcggagtgatgcggagtga

SEQ ID NO: 1065 - DNA, 24 bp, Artificial Sequence
  Description of Artificial Sequence: Synthetic oligonucleotide
  5' Phos
ttcgtgcggattcctgcggattcc

SEQ ID NO: 1066 - DNA, 24 bp, Artificial Sequence
  Description of Artificial Sequence: Synthetic oligonucleotide
  5' Phos
ttcgtgcggctacatgcggctaca

SEQ ID NO: 1067 - DNA, 24 bp, Artificial Sequence
  Description of Artificial Sequence: Synthetic oligonucleotide
  5' Phos
ttcgtgcgtaacaatgcgtaacaa

SEQ ID NO: 1068 - DNA, 24 bp, Artificial Sequence
  Description of Artificial Sequence: Synthetic oligonucleotide
  5' Phos
ttcgtgcgtcctcatgcgtcctca

SEQ ID NO: 1069 - DNA, 24 bp, Artificial Sequence
  Description of Artificial Sequence: Synthetic oligonucleotide
  5' Phos
ttcgtgcgttcagctgcgttcagc

SEQ ID NO: 1070 - DNA, 24 bp, Artificial Sequence
  Description of Artificial Sequence: Synthetic oligonucleotide
  5' Phos
ttcgtgcttcagcgtgcttcagcg

SEQ ID NO: 1071 - DNA, 24 bp, Artificial Sequence
  Description of Artificial Sequence: Synthetic oligonucleotide
  5' Phos
ttcgtgcttgcctctgcttgcctc

SEQ ID NO: 1072 - DNA, 24 bp, Artificial Sequence
  Description of Artificial Sequence: Synthetic oligonucleotide
  5' Phos
ttcgtggaactggctggaactggc

SEQ ID NO: 1073 - DNA, 24 bp, Artificial Sequence
  Description of Artificial Sequence: Synthetic oligonucleotide
  5' Phos
ttcgtgtattggagtgtattggag

SEQ ID NO: 1074 - DNA, 24 bp, Artificial Sequence
  Description of Artificial Sequence: Synthetic oligonucleotide
  5' Phos
ttcgtgtggaacggtgtggaacgg

SEQ ID NO: 1075 - DNA, 24 bp, Artificial Sequence
  Description of Artificial Sequence: Synthetic oligonucleotide
  5' Phos
ttcgtgtggagtcgtgtggagtcg

SEQ ID NO: 1076 - DNA, 24 bp, Artificial Sequence
  Description of Artificial Sequence: Synthetic oligonucleotide
  5' Phos
ttcgtgtgtggccatgtgtggcca

SEQ ID NO: 1077 - DNA, 24 bp, Artificial Sequence
  Description of Artificial Sequence: Synthetic oligonucleotide
  5' Phos
ttcgtgttaagaggtgttaagagg

SEQ ID NO: 1078 - DNA, 24 bp, Artificial Sequence
  Description of Artificial Sequence: Synthetic oligonucleotide
  5' Phos
ttcgtgttactcactgttactcac

SEQ ID NO: 1079 - DNA, 24 bp, Artificial Sequence
  Description of Artificial Sequence: Synthetic oligonucleotide
  5' Phos
ttcgtgttcgcagctgttcgcagc

SEQ ID NO: 1080 - DNA, 24 bp, Artificial Sequence
  Description of Artificial Sequence: Synthetic oligonucleotide
  5' Phos
ttcgtgttggcatatgttggcata

SEQ ID NO: 1081 - DNA, 24 bp, Artificial Sequence
  Description of Artificial Sequence: Synthetic oligonucleotide
  5' Phos
ttcgttaagtgcagttaagtgcag

SEQ ID NO: 1082 - DNA, 24 bp, Artificial Sequence
  Description of Artificial Sequence: Synthetic oligonucleotide
  5' Phos
ttcgttagagatccttagagatcc

SEQ ID NO: 1083 - DNA, 24 bp, Artificial Sequence
  Description of Artificial Sequence: Synthetic oligonucleotide
  5' Phos
ttcgttaggtcagattaggtcaga

SEQ ID NO: 1084 - DNA, 24 bp, Artificial Sequence
  Description of Artificial Sequence: Synthetic oligonucleotide
  5' Phos
ttcgttatctcctgttatctcctg

SEQ ID NO: 1085 - DNA, 24 bp, Artificial Sequence
  Description of Artificial Sequence: Synthetic oligonucleotide
  5' Phos
ttcgttcagtgtcgttcagtgtcg

SEQ ID NO: 1086 - DNA, 24 bp, Artificial Sequence
  Description of Artificial Sequence: Synthetic oligonucleotide
  5' Phos
ttcgttccaagaagttccaagaag

SEQ ID NO: 1087 - DNA, 24 bp, Artificial Sequence
  Description of Artificial Sequence: Synthetic oligonucleotide
  5' Phos
ttcgttccaccgcattccaccgca

SEQ ID NO: 1088 - DNA, 24 bp, Artificial Sequence
  Description of Artificial Sequence: Synthetic oligonucleotide
  5' Phos
ttcgttccactatcttccactatc

SEQ ID NO: 1089 - DNA, 24 bp, Artificial Sequence
  Description of Artificial Sequence: Synthetic oligonucleotide
  5' Phos
ttcgttccacttgattccacttga

SEQ ID NO: 1090 - DNA, 24 bp, Artificial Sequence
  Description of Artificial Sequence: Synthetic oligonucleotide
  5' Phos
ttcgttccgagagcttccgagagc

SEQ ID NO: 1091 - DNA, 24 bp, Artificial Sequence
  Description of Artificial Sequence: Synthetic oligonucleotide
  5' Phos
ttcgttcctgagccttcctgagcc

SEQ ID NO: 1092 - DNA, 24 bp, Artificial Sequence
  Description of Artificial Sequence: Synthetic oligonucleotide
  5' Phos
ttcgttcgagtcgcttcgagtcgc

SEQ ID NO: 1093 - DNA, 24 bp, Artificial Sequence
  Description of Artificial Sequence: Synthetic oligonucleotide
  5' Phos
ttcgttcgtgccagttcgtgccag

SEQ ID NO: 1094 - DNA, 24 bp, Artificial Sequence
  Description of Artificial Sequence: Synthetic oligonucleotide
  5' Phos
ttcgttctacaccattctacacca

SEQ ID NO: 1095 - DNA, 24 bp, Artificial Sequence
  Description of Artificial Sequence: Synthetic oligonucleotide
  5' Phos
ttcgttctcgctccttctcgctcc

SEQ ID NO: 1096 - DNA, 24 bp, Artificial Sequence
  Description of Artificial Sequence: Synthetic oligonucleotide
  5' Phos
ttcgttctggccacttctggccac

SEQ ID NO: 1097 - DNA, 24 bp, Artificial Sequence
  Description of Artificial Sequence: Synthetic oligonucleotide
  5' Phos
ttcgttgaatggtgttgaatggtg

SEQ ID NO: 1098 - DNA, 24 bp, Artificial Sequence
  Description of Artificial Sequence: Synthetic oligonucleotide
  5' Phos
ttcgttgagccgacttgagccgac

SEQ ID NO: 1099 - DNA, 24 bp, Artificial Sequence
  Description of Artificial Sequence: Synthetic oligonucleotide
  5' Phos
ttcgttgcgccaagttgcgccaag

SEQ ID NO: 1100 - DNA, 24 bp, Artificial Sequence
  Description of Artificial Sequence: Synthetic oligonucleotide
  5' Phos
ttcgttgctcttagttgctcttag

SEQ ID NO: 1101 - DNA, 24 bp, Artificial Sequence
  Description of Artificial Sequence: Synthetic oligonucleotide
  5' Phos
ttcgttggcaaggcttggcaaggc

SEQ ID NO: 1102 - DNA, 24 bp, Artificial Sequence
  Description of Artificial Sequence: Synthetic oligonucleotide
  5' Phos
ttcgttggctcacgttggctcacg

SEQ ID NO: 1103 - DNA, 24 bp, Artificial Sequence
  Description of Artificial Sequence: Synthetic oligonucleotide
  5' Phos
ttcgttggcttccattggcttcca

SEQ ID NO: 1104 - DNA, 24 bp, Artificial Sequence
  Description of Artificial Sequence: Synthetic oligonucleotide
  5' Phos
ttcgttgtggatacttgtggatac

SEQ ID NO: 1105 - DNA, 24 bp, Artificial Sequence
  Description of Artificial Sequence: Synthetic oligonucleotide
  5' Phos
ttcgaacacggatgaacacggatg

SEQ ID NO: 1106 - DNA, 24 bp, Artificial Sequence
  Description of Artificial Sequence: Synthetic oligonucleotide
  5' Phos
ttcgaacagaccggaacagaccgg

SEQ ID NO: 1107 - DNA, 24 bp, Artificial Sequence
  Description of Artificial Sequence: Synthetic oligonucleotide
  5' Phos
ttcgaacagtgatcaacagtgatc

SEQ ID NO: 1108 - DNA, 24 bp, Artificial Sequence
  Description of Artificial Sequence: Synthetic oligonucleotide
  5' Phos
ttcgaaccatcttgaaccatcttg

SEQ ID NO: 1109 - DNA, 24 bp, Artificial Sequence
  Description of Artificial Sequence: Synthetic oligonucleotide
  5' Phos
ttcgaacggtgacgaacggtgacg

SEQ ID NO: 1110 - DNA, 24 bp, Artificial Sequence
  Description of Artificial Sequence: Synthetic oligonucleotide
  5' Phos
ttcgaactacgcggaactacgcgg

SEQ ID NO: 1111 - DNA, 24 bp, Artificial Sequence
  Description of Artificial Sequence: Synthetic oligonucleotide
  5' Phos
ttcgaactaggcttaactaggctt

SEQ ID NO: 1112 - DNA, 24 bp, Artificial Sequence
  Description of Artificial Sequence: Synthetic oligonucleotide
  5' Phos
ttcgaactggcgtgaactggcgtg

SEQ ID NO: 1113 - DNA, 24 bp, Artificial Sequence
  Description of Artificial Sequence: Synthetic oligonucleotide
  5' Phos
ttcgaagacaggataagacaggat

SEQ ID NO: 1114 - DNA, 24 bp, Artificial Sequence
  Description of Artificial Sequence: Synthetic oligonucleotide
  5' Phos
ttcgaagagccagtaagagccagt

SEQ ID NO: 1115 - DNA, 24 bp, Artificial Sequence
  Description of Artificial Sequence: Synthetic oligonucleotide
  5' Phos
ttcgaagagtatcgaagagtatcg

SEQ ID NO: 1116 - DNA, 24 bp, Artificial Sequence
  Description of Artificial Sequence: Synthetic oligonucleotide
  5' Phos
ttcgaaggaacactaaggaacact

SEQ ID NO: 1117 - DNA, 24 bp, Artificial Sequence
  Description of Artificial Sequence: Synthetic oligonucleotide
  5' Phos
ttcgaagtcgcaggaagtcgcagg

SEQ ID NO: 1118 - DNA, 24 bp, Artificial Sequence
  Description of Artificial Sequence: Synthetic oligonucleotide
  5' Phos
ttcgaatcacagtcaatcacagtc

SEQ ID NO: 1119 - DNA, 24 bp, Artificial Sequence
  Description of Artificial Sequence: Synthetic oligonucleotide
  5' Phos
ttcgaatcgccattaatcgccatt

SEQ ID NO: 1120 - DNA, 24 bp, Artificial Sequence
  Description of Artificial Sequence: Synthetic oligonucleotide
  5' Phos
ttcgaattgcggccaattgcggcc

SEQ ID NO: 1121 - DNA, 24 bp, Artificial Sequence
  Description of Artificial Sequence: Synthetic oligonucleotide
  5' Phos
ttcgacaactcgcgacaactcgcg

SEQ ID NO: 1122 - DNA, 24 bp, Artificial Sequence
  Description of Artificial Sequence: Synthetic oligonucleotide
  5' Phos
ttcgacaagctgcgacaagctgcg

SEQ ID NO: 1123 - DNA, 24 bp, Artificial Sequence
  Description of Artificial Sequence: Synthetic oligonucleotide
  5' Phos
ttcgacaccaattcacaccaattc

SEQ ID NO: 1124 - DNA, 24 bp, Artificial Sequence
  Description of Artificial Sequence: Synthetic oligonucleotide
  5' Phos
ttcgacacgaaggtacacgaaggt

SEQ ID NO: 1125 - DNA, 24 bp, Artificial Sequence
  Description of Artificial Sequence: Synthetic oligonucleotide
  5' Phos
ttcgacagaatgtgacagaatgtg

SEQ ID NO: 1126 - DNA, 24 bp, Artificial Sequence
  Description of Artificial Sequence: Synthetic oligonucleotide
  5' Phos
ttcgacatagtggtacatagtggt

SEQ ID NO: 1127 - DNA, 24 bp, Artificial Sequence
  Description of Artificial Sequence: Synthetic oligonucleotide
  5' Phos
ttcgaccaccacgtaccaccacgt

SEQ ID NO: 1128 - DNA, 24 bp, Artificial Sequence
  Description of Artificial Sequence: Synthetic oligonucleotide
  5' Phos
ttcgaccgacagctaccgacagct

SEQ ID NO: 1129 - DNA, 24 bp, Artificial Sequence
  Description of Artificial Sequence: Synthetic oligonucleotide
  5' Phos
ttcgaccggctagtaccggctagt

SEQ ID NO: 1130 - DNA, 24 bp, Artificial Sequence
  Description of Artificial Sequence: Synthetic oligonucleotide
  5' Phos
ttcgaccgtagattaccgtagatt

SEQ ID NO: 1131 - DNA, 24 bp, Artificial Sequence
  Description of Artificial Sequence: Synthetic oligonucleotide
  5' Phos
ttcgaccgtgacttaccgtgactt

SEQ ID NO: 1132 - DNA, 24 bp, Artificial Sequence
  Description of Artificial Sequence: Synthetic oligonucleotide
  5' Phos
ttcgacctcacaacacctcacaac

SEQ ID NO: 1133 - DNA, 24 bp, Artificial Sequence
  Description of Artificial Sequence: Synthetic oligonucleotide
  5' Phos
ttcgaccttgtcctaccttgtcct

SEQ ID NO: 1134 - DNA, 24 bp, Artificial Sequence
  Description of Artificial Sequence: Synthetic oligonucleotide
  5' Phos
ttcgacgaagcaggacgaagcagg

SEQ ID NO: 1135 - DNA, 24 bp, Artificial Sequence
  Description of Artificial Sequence: Synthetic oligonucleotide
  5' Phos
ttcgacgactggacacgactggac

SEQ ID NO: 1136 - DNA, 24 bp, Artificial Sequence
  Description of Artificial Sequence: Synthetic oligonucleotide
  5' Phos
ttcgacgagagcagacgagagcag

SEQ ID NO: 1137 - DNA, 24 bp, Artificial Sequence
  Description of Artificial Sequence: Synthetic oligonucleotide
  5' Phos
ttcgacgcctgttgacgcctgttg

SEQ ID NO: 1138 - DNA, 24 bp, Artificial Sequence
  Description of Artificial Sequence: Synthetic oligonucleotide
  5' Phos
ttcgacgcgacttcacgcgacttc

SEQ ID NO: 1139 - DNA, 24 bp, Artificial Sequence
  Description of Artificial Sequence: Synthetic oligonucleotide
  5' Phos
ttcgacggattgatacggattgat

SEQ ID NO: 1140 - DNA, 24 bp, Artificial Sequence
  Description of Artificial Sequence: Synthetic oligonucleotide
  5' Phos
ttcgacggctcatgacggctcatg

SEQ ID NO: 1141 - DNA, 24 bp, Artificial Sequence
  Description of Artificial Sequence: Synthetic oligonucleotide
  5' Phos
ttcgacggtaagatacggtaagat

SEQ ID NO: 1142 - DNA, 24 bp, Artificial Sequence
  Description of Artificial Sequence: Synthetic oligonucleotide
  5' Phos
ttcgacggtagcacacggtagcac

SEQ ID NO: 1143 - DNA, 24 bp, Artificial Sequence
  Description of Artificial Sequence: Synthetic oligonucleotide
  5' Phos
ttcgacggtgttcgacggtgttcg

SEQ ID NO: 1144 - DNA, 24 bp, Artificial Sequence
  Description of Artificial Sequence: Synthetic oligonucleotide
  5' Phos
ttcgacgtcgatggacgtcgatgg

SEQ ID NO: 1145 - DNA, 24 bp, Artificial Sequence
  Description of Artificial Sequence: Synthetic oligonucleotide
  5' Phos
ttcgacgtgcagacacgtgcagac

SEQ ID NO: 1146 - DNA, 24 bp, Artificial Sequence
  Description of Artificial Sequence: Synthetic oligonucleotide
  5' Phos
ttcgacgttccagcacgttccagc

SEQ ID NO: 1147 - DNA, 24 bp, Artificial Sequence
  Description of Artificial Sequence: Synthetic oligonucleotide
  5' Phos
ttcgactagcttgtactagcttgt

SEQ ID NO: 1148 - DNA, 24 bp, Artificial Sequence
  Description of Artificial Sequence: Synthetic oligonucleotide
  5' Phos
ttcgactaggacgcactaggacgc

SEQ ID NO: 1149 - DNA, 24 bp, Artificial Sequence
  Description of Artificial Sequence: Synthetic oligonucleotide
  5' Phos
ttcgactcacctggactcacctgg

SEQ ID NO: 1150 - DNA, 24 bp, Artificial Sequence
  Description of Artificial Sequence: Synthetic oligonucleotide
  5' Phos
ttcgactcatatcgactcatatcg

SEQ ID NO: 1151 - DNA, 24 bp, Artificial Sequence
  Description of Artificial Sequence: Synthetic oligonucleotide
  5' Phos
ttcgactgaccgtgactgaccgtg

SEQ ID NO: 1152 - DNA, 24 bp, Artificial Sequence
  Description of Artificial Sequence: Synthetic oligonucleotide
  5' Phos
ttcgacttctaaccacttctaacc

SEQ ID NO: 1153 - DNA, 24 bp, Artificial Sequence
  Description of Artificial Sequence: Synthetic oligonucleotide
  5' Phos
tgacacttggcgctacttggcgct

SEQ ID NO: 1154 - DNA, 24 bp, Artificial Sequence
  Description of Artificial Sequence: Synthetic oligonucleotide
  5' Phos
tgacagaacgctccagaacgctcc

SEQ ID NO: 1155 - DNA, 24 bp, Artificial Sequence
  Description of Artificial Sequence: Synthetic oligonucleotide
  5' Phos
tgacagaacttaggagaacttagg

SEQ ID NO: 1156 - DNA, 24 bp, Artificial Sequence
  Description of Artificial Sequence: Synthetic oligonucleotide
  5' Phos
tgacagaagcgcatagaagcgcat

SEQ ID NO: 1157 - DNA, 24 bp, Artificial Sequence
  Description of Artificial Sequence: Synthetic oligonucleotide
  5' Phos
tgacagacaatagcagacaatagc

SEQ ID NO: 1158 - DNA, 24 bp, Artificial Sequence
  Description of Artificial Sequence: Synthetic oligonucleotide
  5' Phos
tgacagaccgagacagaccgagac

SEQ ID NO: 1159 - DNA, 24 bp, Artificial Sequence
  Description of Artificial Sequence: Synthetic oligonucleotide
  5' Phos
tgacagacgctgtcagacgctgtc

SEQ ID NO: 1160 - DNA, 24 bp, Artificial Sequence
  Description of Artificial Sequence: Synthetic oligonucleotide
  5' Phos
tgacagacgtagcgagacgtagcg

SEQ ID NO: 1161 - DNA, 24 bp, Artificial Sequence
  Description of Artificial Sequence: Synthetic oligonucleotide
  5' Phos
tgacagagagctctagagagctct

SEQ ID NO: 1162 - DNA, 24 bp, Artificial Sequence
  Description of Artificial Sequence: Synthetic oligonucleotide
  5' Phos
tgacagaggccactagaggccact

SEQ ID NO: 1163 - DNA, 24 bp, Artificial Sequence
  Description of Artificial Sequence: Synthetic oligonucleotide
  5' Phos
tgacagattgccgcagattgccgc

SEQ ID NO: 1164 - DNA, 24 bp, Artificial Sequence
  Description of Artificial Sequence: Synthetic oligonucleotide
  5' Phos
tgacagcacgatgcagcacgatgc

SEQ ID NO: 1165 - DNA, 24 bp, Artificial Sequence
  Description of Artificial Sequence: Synthetic oligonucleotide
  5' Phos
tgacagcagagaatagcagagaat

SEQ ID NO: 1166 - DNA, 24 bp, Artificial Sequence
  Description of Artificial Sequence: Synthetic oligonucleotide
  5' Phos
tgacagccacaaggagccacaagg

SEQ ID NO: 1167 - DNA, 24 bp, Artificial Sequence
  Description of Artificial Sequence: Synthetic oligonucleotide
  5' Phos
tgacagccaggaagagccaggaag

SEQ ID NO: 1168 - DNA, 24 bp, Artificial Sequence
  Description of Artificial Sequence: Synthetic oligonucleotide
  5' Phos
tgacagctctggagagctctggag

SEQ ID NO: 1169 - DNA, 24 bp, Artificial Sequence
  Description of Artificial Sequence: Synthetic oligonucleotide
  5' Phos
tgacagcttggcagagcttggcag

SEQ ID NO: 1170 - DNA, 24 bp, Artificial Sequence
  Description of Artificial Sequence: Synthetic oligonucleotide
  5' Phos
tgacaggaataacgaggaataacg

SEQ ID NO: 1171 - DNA, 24 bp, Artificial Sequence
  Description of Artificial Sequence: Synthetic oligonucleotide
  5' Phos
tgacaggaattgacaggaattgac

SEQ ID NO: 1172 - DNA, 24 bp, Artificial Sequence
  Description of Artificial Sequence: Synthetic oligonucleotide
  5' Phos
tgacaggaggaattaggaggaatt

SEQ ID NO: 1173 - DNA, 24 bp, Artificial Sequence
  Description of Artificial Sequence: Synthetic oligonucleotide
  5' Phos
tgacaggataggccaggataggcc

SEQ ID NO: 1174 - DNA, 24 bp, Artificial Sequence
  Description of Artificial Sequence: Synthetic oligonucleotide
  5' Phos
tgacaggtggccttaggtggcctt

SEQ ID NO: 1175 - DNA, 24 bp, Artificial Sequence
  Description of Artificial Sequence: Synthetic oligonucleotide
  5' Phos
tgacaggtgttgcgaggtgttgcg

SEQ ID NO: 1176 - DNA, 24 bp, Artificial Sequence
  Description of Artificial Sequence: Synthetic oligonucleotide
  5' Phos
tgacaggttaggtgaggttaggtg

SEQ ID NO: 1177 - DNA, 24 bp, Artificial Sequence
  Description of Artificial Sequence: Synthetic oligonucleotide
  5' Phos
tgacagtccgtcctagtccgtcct

SEQ ID NO: 1178 - DNA, 24 bp, Artificial Sequence
  Description of Artificial Sequence: Synthetic oligonucleotide
  5' Phos
tgacagtcgatccgagtcgatccg

SEQ ID NO: 1179 - DNA, 24 bp, Artificial Sequence
  Description of Artificial Sequence: Synthetic oligonucleotide
  5' Phos
tgacagtcgctgctagtcgctgct

SEQ ID NO: 1180 - DNA, 24 bp, Artificial Sequence
  Description of Artificial Sequence: Synthetic oligonucleotide
  5' Phos
tgacagtcgtcctcagtcgtcctc

SEQ ID NO: 1181 - DNA, 24 bp, Artificial Sequence
  Description of Artificial Sequence: Synthetic oligonucleotide
  5' Phos
tgacagtgttccgtagtgttccgt

SEQ ID NO: 1182 - DNA, 24 bp, Artificial Sequence
  Description of Artificial Sequence: Synthetic oligonucleotide
  5' Phos
tgacagttgctcatagttgctcat

SEQ ID NO: 1183 - DNA, 24 bp, Artificial Sequence
  Description of Artificial Sequence: Synthetic oligonucleotide
  5' Phos
tgacataacgtgagataacgtgag

SEQ ID NO: 1184 - DNA, 24 bp, Artificial Sequence
  Description of Artificial Sequence: Synthetic oligonucleotide
  5' Phos
tgacatacgcaggcatacgcaggc

SEQ ID NO: 1185 - DNA, 24 bp, Artificial Sequence
  Description of Artificial Sequence: Synthetic oligonucleotide
  5' Phos
tgacatactgatgcatactgatgc

SEQ ID NO: 1186 - DNA, 24 bp, Artificial Sequence
  Description of Artificial Sequence: Synthetic oligonucleotide
  5' Phos
tgacatagttcgtcatagttcgtc

SEQ ID NO: 1187 - DNA, 24 bp, Artificial Sequence
  Description of Artificial Sequence: Synthetic oligonucleotide
  5' Phos
tgacatatcttcgcatatcttcgc

SEQ ID NO: 1188 - DNA, 24 bp, Artificial Sequence
  Description of Artificial Sequence: Synthetic oligonucleotide
  5' Phos
tgacatatgccttcatatgccttc

SEQ ID NO: 1189 - DNA, 24 bp, Artificial Sequence
  Description of Artificial Sequence: Synthetic oligonucleotide
  5' Phos
tgacatcagatcacatcagatcac

SEQ ID NO: 1190 - DNA, 24 bp, Artificial Sequence
  Description of Artificial Sequence: Synthetic oligonucleotide
  5' Phos
tgacatccaatctgatccaatctg

SEQ ID NO: 1191 - DNA, 24 bp, Artificial Sequence
  Description of Artificial Sequence: Synthetic oligonucleotide
  5' Phos
tgacatccacagcgatccacagcg

SEQ ID NO: 1192 - DNA, 24 bp, Artificial Sequence
  Description of Artificial Sequence: Synthetic oligonucleotide
  5' Phos
tgacatccggaacgatccggaacg

SEQ ID NO: 1193 - DNA, 24 bp, Artificial Sequence
  Description of Artificial Sequence: Synthetic oligonucleotide
  5' Phos
tgacatcggcttccatcggcttcc

SEQ ID NO: 1194 - DNA, 24 bp, Artificial Sequence
  Description of Artificial Sequence: Synthetic oligonucleotide
  5' Phos
tgacatcgtcggagatcgtcggag

SEQ ID NO: 1195 - DNA, 24 bp, Artificial Sequence
  Description of Artificial Sequence: Synthetic oligonucleotide
  5' Phos
tgacatctctcacgatctctcacg

SEQ ID NO: 1196 - DNA, 24 bp, Artificial Sequence
  Description of Artificial Sequence: Synthetic oligonucleotide
  5' Phos
tgacatgcacctgcatgcacctgc

SEQ ID NO: 1197 - DNA, 24 bp, Artificial Sequence
  Description of Artificial Sequence: Synthetic oligonucleotide
  5' Phos
tgacatgcagtcgcatgcagtcgc

SEQ ID NO: 1198 - DNA, 24 bp, Artificial Sequence
  Description of Artificial Sequence: Synthetic oligonucleotide
  5' Phos
tgacatgccgtaggatgccgtagg

SEQ ID NO: 1199 - DNA, 24 bp, Artificial Sequence
  Description of Artificial Sequence: Synthetic oligonucleotide
  5' Phos
tgacatgcgcgatcatgcgcgatc

SEQ ID NO: 1200 - DNA, 24 bp, Artificial Sequence
  Description of Artificial Sequence: Synthetic oligonucleotide
  5' Phos
tgacatgtggtgatatgtggtgat

SEQ ID NO: 1201 - DNA, 24 bp, Artificial Sequence
  Description of Artificial Sequence: Synthetic oligonucleotide
  5' Phos
tgacattacgagccattacgagcc

SEQ ID NO: 1202 - DNA, 24 bp, Artificial Sequence
  Description of Artificial Sequence: Synthetic oligonucleotide
  5' Phos
tgacattccacggcattccacggc

SEQ ID NO: 1203 - DNA, 24 bp, Artificial Sequence
  Description of Artificial Sequence: Synthetic oligonucleotide
  5' Phos
tgacattcggcgtcattcggcgtc

SEQ ID NO: 1204 - DNA, 24 bp, Artificial Sequence
  Description of Artificial Sequence: Synthetic oligonucleotide
  5' Phos
tgacattggaagccattggaagcc

SEQ ID NO: 1205 - DNA, 24 bp, Artificial Sequence
  Description of Artificial Sequence: Synthetic oligonucleotide
  5' Phos
tgacattgtcggccattgtcggcc

SEQ ID NO: 1206 - DNA, 24 bp, Artificial Sequence
  Description of Artificial Sequence: Synthetic oligonucleotide
  5' Phos
tgaccaaccgcttgcaaccgcttg

SEQ ID NO: 1207 - DNA, 24 bp, Artificial Sequence
  Description of Artificial Sequence: Synthetic oligonucleotide
  5' Phos
tgaccaactggtggcaactggtgg

SEQ ID NO: 1208 - DNA, 24 bp, Artificial Sequence
  Description of Artificial Sequence: Synthetic oligonucleotide
  5' Phos
tgaccaagatggtgcaagatggtg

SEQ ID NO: 1209 - DNA, 24 bp, Artificial Sequence
  Description of Artificial Sequence: Synthetic oligonucleotide
  5' Phos
tgaccaagattcgacaagattcga

SEQ ID NO: 1210 - DNA, 24 bp, Artificial Sequence
  Description of Artificial Sequence: Synthetic oligonucleotide
  5' Phos
tgaccaagcacgagcaagcacgag

SEQ ID NO: 1211 - DNA, 24 bp, Artificial Sequence
  Description of Artificial Sequence: Synthetic oligonucleotide
  5' Phos
tgaccaagcctgtgcaagcctgtg

SEQ ID NO: 1212 - DNA, 24 bp, Artificial Sequence
  Description of Artificial Sequence: Synthetic oligonucleotide
  5' Phos
tgaccaagctcacgcaagctcacg

SEQ ID NO: 1213 - DNA, 24 bp, Artificial Sequence
  Description of Artificial Sequence: Synthetic oligonucleotide
  5' Phos
tgaccaaggttgcgcaaggttgcg

SEQ ID NO: 1214 - DNA, 24 bp, Artificial Sequence
  Description of Artificial Sequence: Synthetic oligonucleotide
  5' Phos
tgaccaagtcgacgcaagtcgacg

SEQ ID NO: 1215 - DNA, 24 bp, Artificial Sequence
  Description of Artificial Sequence: Synthetic oligonucleotide
  5' Phos
tgaccaccacgaagcaccacgaag

SEQ ID NO: 1216 - DNA, 24 bp, Artificial Sequence
  Description of Artificial Sequence: Synthetic oligonucleotide
  5' Phos
tgaccaccgatattcaccgatatt

SEQ ID NO: 1217 - DNA, 24 bp, Artificial Sequence
  Description of Artificial Sequence: Synthetic oligonucleotide
  5' Phos
tgaccaccgtcgaacaccgtcgaa

SEQ ID NO: 1218 - DNA, 24 bp, Artificial Sequence
  Description of Artificial Sequence: Synthetic oligonucleotide
  5' Phos
tgaccaccgtgacacaccgtgaca

SEQ ID NO: 1219 - DNA, 24 bp, Artificial Sequence
  Description of Artificial Sequence: Synthetic oligonucleotide
  5' Phos
tgaccacctgctgacacctgctga

SEQ ID NO: 1220 - DNA, 24 bp, Artificial Sequence
  Description of Artificial Sequence: Synthetic oligonucleotide
  5' Phos
tgaccacgcacatacacgcacata

SEQ ID NO: 1221 - DNA, 24 bp, Artificial Sequence
  Description of Artificial Sequence: Synthetic oligonucleotide
  5' Phos
tgaccacgctaaggcacgctaagg

SEQ ID NO: 1222 - DNA, 24 bp, Artificial Sequence
  Description of Artificial Sequence: Synthetic oligonucleotide
  5' Phos
tgaccacgtaatctcacgtaatct

SEQ ID NO: 1223 - DNA, 24 bp, Artificial Sequence
  Description of Artificial Sequence: Synthetic oligonucleotide
  5' Phos
tgaccacgtggagtcacgtggagt

SEQ ID NO: 1224 - DNA, 24 bp, Artificial Sequence
  Description of Artificial Sequence: Synthetic oligonucleotide
  5' Phos
tgaccactcgagagcactcgagag

SEQ ID NO: 1225 - DNA, 24 bp, Artificial Sequence
  Description of Artificial Sequence: Synthetic oligonucleotide
  5' Phos
tgaccactctctgacactctctga

SEQ ID NO: 1226 - DNA, 24 bp, Artificial Sequence
  Description of Artificial Sequence: Synthetic oligonucleotide
  5' Phos
tgaccactctggctcactctggct

SEQ ID NO: 1227 - DNA, 24 bp, Artificial Sequence
  Description of Artificial Sequence: Synthetic oligonucleotide
  5' Phos
tgaccactgccatgcactgccatg

SEQ ID NO: 1228 - DNA, 24 bp, Artificial Sequence
  Description of Artificial Sequence: Synthetic oligonucleotide
  5' Phos
tgaccacttgaactcacttgaact

SEQ ID NO: 1229 - DNA, 24 bp, Artificial Sequence
  Description of Artificial Sequence: Synthetic oligonucleotide
  5' Phos
tgaccagacctgagcagacctgag

SEQ ID NO: 1230 - DNA, 24 bp, Artificial Sequence
  Description of Artificial Sequence: Synthetic oligonucleotide
  5' Phos
tgaccagcgagcatcagcgagcat

SEQ ID NO: 1231 - DNA, 24 bp, Artificial Sequence
  Description of Artificial Sequence: Synthetic oligonucleotide
  5' Phos
tgaccaggaagaggcaggaagagg

SEQ ID NO: 1232 - DNA, 24 bp, Artificial Sequence
  Description of Artificial Sequence: Synthetic oligonucleotide
  5' Phos
tgaccagtctcatacagtctcata

SEQ ID NO: 1233 - DNA, 24 bp, Artificial Sequence
  Description of Artificial Sequence: Synthetic oligonucleotide
  5' Phos
tgaccagttatcgacagttatcga

SEQ ID NO: 1234 - DNA, 24 bp, Artificial Sequence
  Description of Artificial Sequence: Synthetic oligonucleotide
  5' Phos
tgaccatacacgcgcatacacgcg

SEQ ID NO: 1235 - DNA, 24 bp, Artificial Sequence
  Description of Artificial Sequence: Synthetic oligonucleotide
  5' Phos
tgaccataccgacgcataccgacg

SEQ ID NO: 1236 - DNA, 24 bp, Artificial Sequence
  Description of Artificial Sequence: Synthetic oligonucleotide
  5' Phos
tgaccatcaatggtcatcaatggt

SEQ ID NO: 1237 - DNA, 24 bp, Artificial Sequence
  Description of Artificial Sequence: Synthetic oligonucleotide
  5' Phos
tgaccatgacaccgcatgacaccg

SEQ ID NO: 1238 - DNA, 24 bp, Artificial Sequence
  Description of Artificial Sequence: Synthetic oligonucleotide
  5' Phos
tgaccatggttcggcatggttcgg

SEQ ID NO: 1239 - DNA, 24 bp, Artificial Sequence
  Description of Artificial Sequence: Synthetic oligonucleotide
  5' Phos
tgaccattggagcgcattggagcg

SEQ ID NO: 1240 - DNA, 24 bp, Artificial Sequence
  Description of Artificial Sequence: Synthetic oligonucleotide
  5' Phos
tgacccaacgagagccaacgagag

SEQ ID NO: 1241 - DNA, 24 bp, Artificial Sequence
  Description of Artificial Sequence: Synthetic oligonucleotide
  5' Phos
tgacccaagaccagccaagaccag

SEQ ID NO: 1242 - DNA, 24 bp, Artificial Sequence
  Description of Artificial Sequence: Synthetic oligonucleotide
  5' Phos
tgacccaatcacggccaatcacgg

SEQ ID NO: 1243 - DNA, 24 bp, Artificial Sequence
  Description of Artificial Sequence: Synthetic oligonucleotide
  5' Phos
tgacccaccgttgtccaccgttgt

SEQ ID NO: 1244 - DNA, 24 bp, Artificial Sequence
  Description of Artificial Sequence: Synthetic oligonucleotide
  5' Phos
tgacccagatcggaccagatcgga

SEQ ID NO: 1245 - DNA, 24 bp, Artificial Sequence
  Description of Artificial Sequence: Synthetic oligonucleotide
  5' Phos
tgacccgaagtcagccgaagtcag

SEQ ID NO: 1246 - DNA, 24 bp, Artificial Sequence
  Description of Artificial Sequence: Synthetic oligonucleotide
  5' Phos
tgacccgctgaagtccgctgaagt

SEQ ID NO: 1247 - DNA, 24 bp, Artificial Sequence
  Description of Artificial Sequence: Synthetic oligonucleotide
  5' Phos
tgacccggaccataccggaccata

SEQ ID NO: 1248 - DNA, 24 bp, Artificial Sequence
  Description of Artificial Sequence: Synthetic oligonucleotide
  5' Phos
tgacccgttctaggccgttctagg

SEQ ID NO: 1249 - DNA, 24 bp, Artificial Sequence
  Description of Artificial Sequence: Synthetic oligonucleotide
  5' Phos
tgaccctaatgcggcctaatgcgg

SEQ ID NO: 1250 - DNA, 24 bp, Artificial Sequence
  Description of Artificial Sequence: Synthetic oligonucleotide
  5' Phos
tgaccctatgacgacctatgacga

SEQ ID NO: 1251 - DNA, 24 bp, Artificial Sequence
  Description of Artificial Sequence: Synthetic oligonucleotide
  5' Phos
tgaccctcaccagtcctcaccagt

SEQ ID NO: 1252 - DNA, 24 bp, Artificial Sequence
  Description of Artificial Sequence: Synthetic oligonucleotide
  5' Phos
tgaccctgaagacgcctgaagacg

SEQ ID NO: 1253 - DNA, 24 bp, Artificial Sequence
  Description of Artificial Sequence: Synthetic oligonucleotide
  5' Phos
tgaccctgactcctcctgactcct

SEQ ID NO: 1254 - DNA, 24 bp, Artificial Sequence
  Description of Artificial Sequence: Synthetic oligonucleotide
  5' Phos
tgaccgaagagtggcgaagagtgg

SEQ ID NO: 1255 - DNA, 24 bp, Artificial Sequence
  Description of Artificial Sequence: Synthetic oligonucleotide
  5' Phos
tgaccgaaggtggtcgaaggtggt

SEQ ID NO: 1256 - DNA, 24 bp, Artificial Sequence
  Description of Artificial Sequence: Synthetic oligonucleotide
  5' Phos
tgaccgactagcagcgactagcag

SEQ ID NO: 1257 - DNA, 24 bp, Artificial Sequence
  Description of Artificial Sequence: Synthetic oligonucleotide
  5' Phos
tgaccgactcgagacgactcgaga

SEQ ID NO: 1258 - DNA, 24 bp, Artificial Sequence
  Description of Artificial Sequence: Synthetic oligonucleotide
  5' Phos
tgaccgacttacaacgacttacaa

SEQ ID NO: 1259 - DNA, 24 bp, Artificial Sequence
  Description of Artificial Sequence: Synthetic oligonucleotide
  5' Phos
tgaccgaggattaacgaggattaa

SEQ ID NO: 1260 - DNA, 24 bp, Artificial Sequence
  Description of Artificial Sequence: Synthetic oligonucleotide
  5' Phos
tgaccgaggcatgtcgaggcatgt

SEQ ID NO: 1261 - DNA, 24 bp, Artificial Sequence
  Description of Artificial Sequence: Synthetic oligonucleotide
  5' Phos
tgaccgagtctgctcgagtctgct

SEQ ID NO: 1262 - DNA, 24 bp, Artificial Sequence
  Description of Artificial Sequence: Synthetic oligonucleotide
  5' Phos
tgaccgagtgagcacgagtgagca

SEQ ID NO: 1263 - DNA, 24 bp, Artificial Sequence
  Description of Artificial Sequence: Synthetic oligonucleotide
  5' Phos
tgaccgatcggaagcgatcggaag

SEQ ID NO: 1264 - DNA, 24 bp, Artificial Sequence
  Description of Artificial Sequence: Synthetic oligonucleotide
  5' Phos
tgaccgatctaccgcgatctaccg

SEQ ID NO: 1265 - DNA, 24 bp, Artificial Sequence
  Description of Artificial Sequence: Synthetic oligonucleotide
  5' Phos
tgaccgccaagcttcgccaagctt

SEQ ID NO: 1266 - DNA, 24 bp, Artificial Sequence
  Description of Artificial Sequence: Synthetic oligonucleotide
  5' Phos
tgaccgccagaattcgccagaatt

SEQ ID NO: 1267 - DNA, 24 bp, Artificial Sequence
  Description of Artificial Sequence: Synthetic oligonucleotide
  5' Phos
tgaccgcgaatggacgcgaatgga

SEQ ID NO: 1268 - DNA, 24 bp, Artificial Sequence
  Description of Artificial Sequence: Synthetic oligonucleotide
  5' Phos
tgaccgctcatcctcgctcatcct

SEQ ID NO: 1269 - DNA, 24 bp, Artificial Sequence
  Description of Artificial Sequence: Synthetic oligonucleotide
  5' Phos
tgaccgctcgaatgcgctcgaatg

SEQ ID NO: 1270 - DNA, 24 bp, Artificial Sequence
  Description of Artificial Sequence: Synthetic oligonucleotide
  5' Phos
tgaccgcttactatcgcttactat

SEQ ID NO: 1271 - DNA, 24 bp, Artificial Sequence
  Description of Artificial Sequence: Synthetic oligonucleotide
  5' Phos
tgaccgcttagcgtcgcttagcgt

SEQ ID NO: 1272 - DNA, 24 bp, Artificial Sequence
  Description of Artificial Sequence: Synthetic oligonucleotide
  5' Phos
tgaccggacttaagcggacttaag

SEQ ID NO: 1273 - DNA, 24 bp, Artificial Sequence
  Description of Artificial Sequence: Synthetic oligonucleotide
  5' Phos
tgaccggcgaacaacggcgaacaa

SEQ ID NO: 1274 - DNA, 24 bp, Artificial Sequence
  Description of Artificial Sequence: Synthetic oligonucleotide
  5' Phos
tgaccggcttggaacggcttggaa

SEQ ID NO: 1275 - DNA, 24 bp, Artificial Sequence
  Description of Artificial Sequence: Synthetic oligonucleotide
  5' Phos
tgaccggtagtgctcggtagtgct

SEQ ID NO: 1276 - DNA, 24 bp, Artificial Sequence
  Description of Artificial Sequence: Synthetic oligonucleotide
  5' Phos
tgaccggttacacacggttacaca

SEQ ID NO: 1277 - DNA, 24 bp, Artificial Sequence
  Description of Artificial Sequence: Synthetic oligonucleotide
  5' Phos
tgaccgtaccgtgtcgtaccgtgt

SEQ ID NO: 1278 - DNA, 24 bp, Artificial Sequence
  Description of Artificial Sequence: Synthetic oligonucleotide
  5' Phos
tgaccgtagagccacgtagagcca

SEQ ID NO: 1279 - DNA, 24 bp, Artificial Sequence
  Description of Artificial Sequence: Synthetic oligonucleotide
  5' Phos
tgaccgtaggactgcgtaggactg

SEQ ID NO: 1280 - DNA, 24 bp, Artificial Sequence
  Description of Artificial Sequence: Synthetic oligonucleotide
  5' Phos
tgaccgtatcacaacgtatcacaa

SEQ ID NO: 1281 - DNA, 24 bp, Artificial Sequence
  Description of Artificial Sequence: Synthetic oligonucleotide
  5' Phos
tgaccgtgttgcgacgtgttgcga

SEQ ID NO: 1282 - DNA, 24 bp, Artificial Sequence
  Description of Artificial Sequence: Synthetic oligonucleotide
  5' Phos
tgaccgttggtccacgttggtcca

SEQ ID NO: 1283 - DNA, 24 bp, Artificial Sequence
  Description of Artificial Sequence: Synthetic oligonucleotide
  5' Phos
tgacctacagccgactacagccga

SEQ ID NO: 1284 - DNA, 24 bp, Artificial Sequence
  Description of Artificial Sequence: Synthetic oligonucleotide
  5' Phos
tgacctacgcaaggctacgcaagg

SEQ ID NO: 1285 - DNA, 24 bp, Artificial Sequence
  Description of Artificial Sequence: Synthetic oligonucleotide
  5' Phos
tgacctacggtgtgctacggtgtg

SEQ ID NO: 1286 - DNA, 24 bp, Artificial Sequence
  Description of Artificial Sequence: Synthetic oligonucleotide
  5' Phos
tgacctacgttcctctacgttcct

SEQ ID NO: 1287 - DNA, 24 bp, Artificial Sequence
  Description of Artificial Sequence: Synthetic oligonucleotide
  5' Phos
tgacctagaggcagctagaggcag

SEQ ID NO: 1288 - DNA, 24 bp, Artificial Sequence
  Description of Artificial Sequence: Synthetic oligonucleotide
  5' Phos
tgacctaggtccagctaggtccag

SEQ ID NO: 1289 - DNA, 24 bp, Artificial Sequence
  Description of Artificial Sequence: Synthetic oligonucleotide
  5' Phos
tgacctaggtcgctctaggtcgct

SEQ ID NO: 1290 - DNA, 24 bp, Artificial Sequence
  Description of Artificial Sequence: Synthetic oligonucleotide
  5' Phos
tgacctatcgccgtctatcgccgt

SEQ ID NO: 1291 - DNA, 24 bp, Artificial Sequence
  Description of Artificial Sequence: Synthetic oligonucleotide
  5' Phos
tgacctatggatctctatggatct

SEQ ID NO: 1292 - DNA, 24 bp, Artificial Sequence
  Description of Artificial Sequence: Synthetic oligonucleotide
  5' Phos
tgacctcgcgagttctcgcgagtt

SEQ ID NO: 1293 - DNA, 24 bp, Artificial Sequence
  Description of Artificial Sequence: Synthetic oligonucleotide
  5' Phos
tgacctcgtggcaactcgtggcaa

SEQ ID NO: 1294 - DNA, 24 bp, Artificial Sequence
  Description of Artificial Sequence: Synthetic oligonucleotide
  5' Phos
tgacctctacaactctctacaact

SEQ ID NO: 1295 - DNA, 24 bp, Artificial Sequence
  Description of Artificial Sequence: Synthetic oligonucleotide
  5' Phos
tgacctctatatcgctctatatcg

SEQ ID NO: 1296 - DNA, 24 bp, Artificial Sequence
  Description of Artificial Sequence: Synthetic oligonucleotide
  5' Phos
tgacctctccttcactctccttca

SEQ ID NO: 1297 - DNA, 24 bp, Artificial Sequence
  Description of Artificial Sequence: Synthetic oligonucleotide
  5' Phos
tgacctctcttgcgctctcttgcg

SEQ ID NO: 1298 - DNA, 24 bp, Artificial Sequence
  Description of Artificial Sequence: Synthetic oligonucleotide
  5' Phos
tgacctctgcgttgctctgcgttg

SEQ ID NO: 1299 - DNA, 24 bp, Artificial Sequence
  Description of Artificial Sequence: Synthetic oligonucleotide
  5' Phos
tgacctgaatccagctgaatccag

SEQ ID NO: 1300 - DNA, 24 bp, Artificial Sequence
  Description of Artificial Sequence: Synthetic oligonucleotide
  5' Phos
tgacctgagcttggctgagcttgg

SEQ ID NO: 1301 - DNA, 24 bp, Artificial Sequence
  Description of Artificial Sequence: Synthetic oligonucleotide
  5' Phos
tgacctggatccgactggatccga

SEQ ID NO: 1302 - DNA, 24 bp, Artificial Sequence
  Description of Artificial Sequence: Synthetic oligonucleotide
  5' Phos
tgacctggtctgatctggtctgat

SEQ ID NO: 1303 - DNA, 24 bp, Artificial Sequence
  Description of Artificial Sequence: Synthetic oligonucleotide
  5' Phos
tgacctgtccacagctgtccacag

SEQ ID NO: 1304 - DNA, 24 bp, Artificial Sequence
  Description of Artificial Sequence: Synthetic oligonucleotide
  5' Phos
tgacctgtcctcctctgtcctcct

SEQ ID NO: 1305 - DNA, 24 bp, Artificial Sequence
  Description of Artificial Sequence: Synthetic oligonucleotide
  5' Phos
tgacctgtcggatgctgtcggatg

SEQ ID NO: 1306 - DNA, 24 bp, Artificial Sequence
  Description of Artificial Sequence: Synthetic oligonucleotide
  5' Phos
tgaccttcatctgacttcatctga

SEQ ID NO: 1307 - DNA, 24 bp, Artificial Sequence
  Description of Artificial Sequence: Synthetic oligonucleotide
  5' Phos
tgaccttcctgcgtcttcctgcgt

SEQ ID NO: 1308 - DNA, 24 bp, Artificial Sequence
  Description of Artificial Sequence: Synthetic oligonucleotide
  5' Phos
tgaccttcggctagcttcggctag

SEQ ID NO: 1309 - DNA, 24 bp, Artificial Sequence
  Description of Artificial Sequence: Synthetic oligonucleotide
  5' Phos
tgaccttcttatggcttcttatgg

SEQ ID NO: 1310 - DNA, 24 bp, Artificial Sequence
  Description of Artificial Sequence: Synthetic oligonucleotide
  5' Phos
tgaccttcttggatcttcttggat

SEQ ID NO: 1311 - DNA, 24 bp, Artificial Sequence
  Description of Artificial Sequence: Synthetic oligonucleotide
  5' Phos
tgaccttgcgatggcttgcgatgg

SEQ ID NO: 1312 - DNA, 24 bp, Artificial Sequence
  Description of Artificial Sequence: Synthetic oligonucleotide
  5' Phos
tgacgaacctcagcgaacctcagc

SEQ ID NO: 1313 - DNA, 24 bp, Artificial Sequence
  Description of Artificial Sequence: Synthetic oligonucleotide
  5' Phos
tgacgaacggattagaacggatta

SEQ ID NO: 1314 - DNA, 24 bp, Artificial Sequence
  Description of Artificial Sequence: Synthetic oligonucleotide
  5' Phos
tgacgaacgtcattgaacgtcatt

SEQ ID NO: 1315 - DNA, 24 bp, Artificial Sequence
  Description of Artificial Sequence: Synthetic oligonucleotide
  5' Phos
tgacgaactgatccgaactgatcc

SEQ ID NO: 1316 - DNA, 24 bp, Artificial Sequence
  Description of Artificial Sequence: Synthetic oligonucleotide
  5' Phos
tgacgacagcagtcgacagcagtc

SEQ ID NO: 1317 - DNA, 24 bp, Artificial Sequence
  Description of Artificial Sequence: Synthetic oligonucleotide
  5' Phos
tgacgaccgaatgtgaccgaatgt

SEQ ID NO: 1318 - DNA, 24 bp, Artificial Sequence
  Description of Artificial Sequence: Synthetic oligonucleotide
  5' Phos
tgacgacgccatcagacgccatca

SEQ ID NO: 1319 - DNA, 24 bp, Artificial Sequence
  Description of Artificial Sequence: Synthetic oligonucleotide
  5' Phos
tgacgacgcgatacgacgcgatac

SEQ ID NO: 1320 - DNA, 24 bp, Artificial Sequence
  Description of Artificial Sequence: Synthetic oligonucleotide
  5' Phos
tgacgacgctgtgagacgctgtga

SEQ ID NO: 1321 - DNA, 24 bp, Artificial Sequence
  Description of Artificial Sequence: Synthetic oligonucleotide
  5' Phos
tgacgacggaccttgacggacctt

SEQ ID NO: 1322 - DNA, 24 bp, Artificial Sequence
  Description of Artificial Sequence: Synthetic oligonucleotide
  5' Phos
tgacgacggagtctgacggagtct

SEQ ID NO: 1323 - DNA, 24 bp, Artificial Sequence
  Description of Artificial Sequence: Synthetic oligonucleotide
  5' Phos
tgacgagcacaaccgagcacaacc

SEQ ID NO: 1324 - DNA, 24 bp, Artificial Sequence
  Description of Artificial Sequence: Synthetic oligonucleotide
  5' Phos
tgacgaggaagaccgaggaagacc

SEQ ID NO: 1325 - DNA, 24 bp, Artificial Sequence
  Description of Artificial Sequence: Synthetic oligonucleotide
  5' Phos
tgacgaggcacgatgaggcacgat

SEQ ID NO: 1326 - DNA, 24 bp, Artificial Sequence
  Description of Artificial Sequence: Synthetic oligonucleotide
  5' Phos
tgacgaggtgaagcgaggtgaagc

SEQ ID NO: 1327 - DNA, 24 bp, Artificial Sequence
  Description of Artificial Sequence: Synthetic oligonucleotide
  5' Phos
tgacgagtcacaccgagtcacacc

SEQ ID NO: 1328 - DNA, 24 bp, Artificial Sequence
  Description of Artificial Sequence: Synthetic oligonucleotide
  5' Phos
tgacgagtccagacgagtccagac

SEQ ID NO: 1329 - DNA, 24 bp, Artificial Sequence
  Description of Artificial Sequence: Synthetic oligonucleotide
  5' Phos
tgacgataacctgtgataacctgt

SEQ ID NO: 1330 - DNA, 24 bp, Artificial Sequence
  Description of Artificial Sequence: Synthetic oligonucleotide
  5' Phos
tgacgatccaaggcgatccaaggc

SEQ ID NO: 1331 - DNA, 24 bp, Artificial Sequence
  Description of Artificial Sequence: Synthetic oligonucleotide
  5' Phos
tgacgatcgagccagatcgagcca

SEQ ID NO: 1332 - DNA, 24 bp, Artificial Sequence
  Description of Artificial Sequence: Synthetic oligonucleotide
  5' Phos
tgacgatggcaatcgatggcaatc

SEQ ID NO: 1333 - DNA, 24 bp, Artificial Sequence
  Description of Artificial Sequence: Synthetic oligonucleotide
  5' Phos
tgacgattaccaacgattaccaac

SEQ ID NO: 1334 - DNA, 24 bp, Artificial Sequence
  Description of Artificial Sequence: Synthetic oligonucleotide
  5' Phos
tgacgattcgtcttgattcgtctt

SEQ ID NO: 1335 - DNA, 24 bp, Artificial Sequence
  Description of Artificial Sequence: Synthetic oligonucleotide
  5' Phos
tgacgattgttggagattgttgga

SEQ ID NO: 1336 - DNA, 24 bp, Artificial Sequence
  Description of Artificial Sequence: Synthetic oligonucleotide
  5' Phos
tgacgcaacacggagcaacacgga

SEQ ID NO: 1337 - DNA, 24 bp, Artificial Sequence
  Description of Artificial Sequence: Synthetic oligonucleotide
  5' Phos
tgacgcaatggtacgcaatggtac

SEQ ID NO: 1338 - DNA, 24 bp, Artificial Sequence
  Description of Artificial Sequence: Synthetic oligonucleotide
  5' Phos
tgacgcaccacattgcaccacatt

SEQ ID NO: 1339 - DNA, 24 bp, Artificial Sequence
  Description of Artificial Sequence: Synthetic oligonucleotide
  5' Phos
tgacgcagattggcgcagattggc

SEQ ID NO: 1340 - DNA, 24 bp, Artificial Sequence
  Description of Artificial Sequence: Synthetic oligonucleotide
  5' Phos
tgacgcaggatagcgcaggatagc

SEQ ID NO: 1341 - DNA, 24 bp, Artificial Sequence
  Description of Artificial Sequence: Synthetic oligonucleotide
  5' Phos
tgacgcattaatccgcattaatcc

SEQ ID NO: 1342 - DNA, 24 bp, Artificial Sequence
  Description of Artificial Sequence: Synthetic oligonucleotide
  5' Phos
tgacgccaccatctgccaccatct

SEQ ID NO: 1343 - DNA, 24 bp, Artificial Sequence
  Description of Artificial Sequence: Synthetic oligonucleotide
  5' Phos
tgacgccagataccgccagatacc

SEQ ID NO: 1344 - DNA, 24 bp, Artificial Sequence
  Description of Artificial Sequence: Synthetic oligonucleotide
  5' Phos
tgacgccatagatagccatagata

SEQ ID NO: 1345 - DNA, 24 bp, Artificial Sequence
  Description of Artificial Sequence: Synthetic oligonucleotide
  5' Phos
tcccgccattggacgccattggac

SEQ ID NO: 1346 - DNA, 24 bp, Artificial Sequence
  Description of Artificial Sequence: Synthetic oligonucleotide
  5' Phos
tcccgccgaatcctgccgaatcct

SEQ ID NO: 1347 - DNA, 24 bp, Artificial Sequence
  Description of Artificial Sequence: Synthetic oligonucleotide
  5' Phos
tcccgccgtgtctagccgtgtcta

SEQ ID NO: 1348 - DNA, 24 bp, Artificial Sequence
  Description of Artificial Sequence: Synthetic oligonucleotide
  5' Phos
tcccgccttatctcgccttatctc

SEQ ID NO: 1349 - DNA, 24 bp, Artificial Sequence
  Description of Artificial Sequence: Synthetic oligonucleotide
  5' Phos
tcccgccttcgcttgccttcgctt

SEQ ID NO: 1350 - DNA, 24 bp, Artificial Sequence
  Description of Artificial Sequence: Synthetic oligonucleotide
  5' Phos
tcccgcgaagtggtgcgaagtggt

SEQ ID NO: 1351 - DNA, 24 bp, Artificial Sequence
  Description of Artificial Sequence: Synthetic oligonucleotide
  5' Phos
tcccgcgaatatctgcgaatatct

SEQ ID NO: 1352 - DNA, 24 bp, Artificial Sequence
  Description of Artificial Sequence: Synthetic oligonucleotide
  5' Phos
tcccgcgctgatacgcgctgatac

SEQ ID NO: 1353 - DNA, 24 bp, Artificial Sequence
  Description of Artificial Sequence: Synthetic oligonucleotide
  5' Phos
tcccgcggacttctgcggacttct

SEQ ID NO: 1354 - DNA, 24 bp, Artificial Sequence
  Description of Artificial Sequence: Synthetic oligonucleotide
  5' Phos
tcccgcggataagtgcggataagt

SEQ ID NO: 1355 - DNA, 24 bp, Artificial Sequence
  Description of Artificial Sequence: Synthetic oligonucleotide
  5' Phos
tcccgcggtccattgcggtccatt

SEQ ID NO: 1356 - DNA, 24 bp, Artificial Sequence
  Description of Artificial Sequence: Synthetic oligonucleotide
  5' Phos
tcccgctcagttaagctcagttaa

SEQ ID NO: 1357 - DNA, 24 bp, Artificial Sequence
  Description of Artificial Sequence: Synthetic oligonucleotide
  5' Phos
tcccgctcattctagctcattcta

SEQ ID NO: 1358 - DNA, 24 bp, Artificial Sequence
  Description of Artificial Sequence: Synthetic oligonucleotide
  5' Phos
tcccgctcctaagcgctcctaagc

SEQ ID NO: 1359 - DNA, 24 bp, Artificial Sequence
  Description of Artificial Sequence: Synthetic oligonucleotide
  5' Phos
tcccgctggaaggagctggaagga

SEQ ID NO: 1360 - DNA, 24 bp, Artificial Sequence
  Description of Artificial Sequence: Synthetic oligonucleotide
  5' Phos
tcccggaacaatgtggaacaatgt

SEQ ID NO: 1361 - DNA, 24 bp, Artificial Sequence
  Description of Artificial Sequence: Synthetic oligonucleotide
  5' Phos
tcccggaacatctcggaacatctc

SEQ ID NO: 1362 - DNA, 24 bp, Artificial Sequence
  Description of Artificial Sequence: Synthetic oligonucleotide
  5' Phos
tcccggaaccagtaggaaccagta

SEQ ID NO: 1363 - DNA, 24 bp, Artificial Sequence
  Description of Artificial Sequence: Synthetic oligonucleotide
  5' Phos
tcccggaacgacttggaacgactt

SEQ ID NO: 1364 - DNA, 24 bp, Artificial Sequence
  Description of Artificial Sequence: Synthetic oligonucleotide
  5' Phos
tcccggaagatgatggaagatgat

SEQ ID NO: 1365 - DNA, 24 bp, Artificial Sequence
  Description of Artificial Sequence: Synthetic oligonucleotide
  5' Phos
tcccggaaggagacggaaggagac

SEQ ID NO: 1366 - DNA, 24 bp, Artificial Sequence
  Description of Artificial Sequence: Synthetic oligonucleotide
  5' Phos
tcccggaagtggtaggaagtggta

SEQ ID NO: 1367 - DNA, 24 bp, Artificial Sequence
  Description of Artificial Sequence: Synthetic oligonucleotide
  5' Phos
tcccggaatcaggtggaatcaggt

SEQ ID NO: 1368 - DNA, 24 bp, Artificial Sequence
  Description of Artificial Sequence: Synthetic oligonucleotide
  5' Phos
tcccggaatgtgtaggaatgtgta

SEQ ID NO: 1369 - DNA, 24 bp, Artificial Sequence
  Description of Artificial Sequence: Synthetic oligonucleotide
  5' Phos
tcccggagataggaggagatagga

SEQ ID NO: 1370 - DNA, 24 bp, Artificial Sequence
  Description of Artificial Sequence: Synthetic oligonucleotide
  5' Phos
tcccggagcaatccggagcaatcc

SEQ ID NO: 1371 - DNA, 24 bp, Artificial Sequence
  Description of Artificial Sequence: Synthetic oligonucleotide
  5' Phos
tcccggaggacatcggaggacatc

SEQ ID NO: 1372 - DNA, 24 bp, Artificial Sequence
  Description of Artificial Sequence: Synthetic oligonucleotide
  5' Phos
tcccggcaatagccggcaatagcc

SEQ ID NO: 1373 - DNA, 24 bp, Artificial Sequence
  Description of Artificial Sequence: Synthetic oligonucleotide
  5' Phos
tcccggcagaaggaggcagaagga

SEQ ID NO: 1374 - DNA, 24 bp, Artificial Sequence
  Description of Artificial Sequence: Synthetic oligonucleotide
  5' Phos
tcccggcaggaataggcaggaata

SEQ ID NO: 1375 - DNA, 24 bp, Artificial Sequence
  Description of Artificial Sequence: Synthetic oligonucleotide
  5' Phos
tcccggcatacaccggcatacacc

SEQ ID NO: 1376 - DNA, 24 bp, Artificial Sequence
  Description of Artificial Sequence: Synthetic oligonucleotide
  5' Phos
tcccggccgttgtaggccgttgta

SEQ ID NO: 1377 - DNA, 24 bp, Artificial Sequence
  Description of Artificial Sequence: Synthetic oligonucleotide
  5' Phos
tcccggcctgcttaggcctgctta

SEQ ID NO: 1378 - DNA, 24 bp, Artificial Sequence
  Description of Artificial Sequence: Synthetic oligonucleotide
  5' Phos
tcccggcgaggtaaggcgaggtaa

SEQ ID NO: 1379 - DNA, 24 bp, Artificial Sequence
  Description of Artificial Sequence: Synthetic oligonucleotide
  5' Phos
tcccggcgtgacatggcgtgacat

SEQ ID NO: 1380 - DNA, 24 bp, Artificial Sequence
  Description of Artificial Sequence: Synthetic oligonucleotide
  5' Phos
tcccggctccaagaggctccaaga

SEQ ID NO: 1381 - DNA, 24 bp, Artificial Sequence
  Description of Artificial Sequence: Synthetic oligonucleotide
  5' Phos
tcccggctgctcaaggctgctcaa

SEQ ID NO: 1382 - DNA, 24 bp, Artificial Sequence
  Description of Artificial Sequence: Synthetic oligonucleotide
  5' Phos
tcccggctgtgcttggctgtgctt

SEQ ID NO: 1383 - DNA, 24 bp, Artificial Sequence
  Description of Artificial Sequence: Synthetic oligonucleotide
  5' Phos
tcccggcttctgtcggcttctgtc

SEQ ID NO: 1384 - DNA, 24 bp, Artificial Sequence
  Description of Artificial Sequence: Synthetic oligonucleotide
  5' Phos
tcccggtatcgcttggtatcgctt

SEQ ID NO: 1385 - DNA, 24 bp, Artificial Sequence
  Description of Artificial Sequence: Synthetic oligonucleotide
  5' Phos
tcccggtccttccaggtccttcca

SEQ ID NO: 1386 - DNA, 24 bp, Artificial Sequence
  Description of Artificial Sequence: Synthetic oligonucleotide
  5' Phos
tcccggtcggttatggtcggttat

SEQ ID NO: 1387 - DNA, 24 bp, Artificial Sequence
  Description of Artificial Sequence: Synthetic oligonucleotide
  5' Phos
tcccggtctgacgaggtctgacga

SEQ ID NO: 1388 - DNA, 24 bp, Artificial Sequence
  Description of Artificial Sequence: Synthetic oligonucleotide
  5' Phos
tcccggtgaccactggtgaccact

SEQ ID NO: 1389 - DNA, 24 bp, Artificial Sequence
  Description of Artificial Sequence: Synthetic oligonucleotide
  5' Phos
tcccggtgagtccaggtgagtcca

SEQ ID NO: 1390 - DNA, 24 bp, Artificial Sequence
  Description of Artificial Sequence: Synthetic oligonucleotide
  5' Phos
tcccggtggcgaatggtggcgaat

SEQ ID NO: 1391 - DNA, 24 bp, Artificial Sequence
  Description of Artificial Sequence: Synthetic oligonucleotide
  5' Phos
tcccggtgtatatcggtgtatatc

SEQ ID NO: 1392 - DNA, 24 bp, Artificial Sequence
  Description of Artificial Sequence: Synthetic oligonucleotide
  5' Phos
tcccggttccttaaggttccttaa

SEQ ID NO: 1393 - DNA, 24 bp, Artificial Sequence
  Description of Artificial Sequence: Synthetic oligonucleotide
  5' Phos
tcccggttctacaaggttctacaa

SEQ ID NO: 1394 - DNA, 24 bp, Artificial Sequence
  Description of Artificial Sequence: Synthetic oligonucleotide
  5' Phos
tcccggttggcgttggttggcgtt

SEQ ID NO: 1395 - DNA, 24 bp, Artificial Sequence
  Description of Artificial Sequence: Synthetic oligonucleotide
  5' Phos
tcccgtaacacgctgtaacacgct

SEQ ID NO: 1396 - DNA, 24 bp, Artificial Sequence
  Description of Artificial Sequence: Synthetic oligonucleotide
  5' Phos
tcccgtagagcgacgtagagcgac

SEQ ID NO: 1397 - DNA, 24 bp, Artificial Sequence
  Description of Artificial Sequence: Synthetic oligonucleotide
  5' Phos
tcccgtagctgctcgtagctgctc

SEQ ID NO: 1398 - DNA, 24 bp, Artificial Sequence
  Description of Artificial Sequence: Synthetic oligonucleotide
  5' Phos
tcccgtaggtggatgtaggtggat

SEQ ID NO: 1399 - DNA, 24 bp, Artificial Sequence
  Description of Artificial Sequence: Synthetic oligonucleotide
  5' Phos
tcccgtagtcagccgtagtcagcc

SEQ ID NO: 1400 - DNA, 24 bp, Artificial Sequence
  Description of Artificial Sequence: Synthetic oligonucleotide
  5' Phos
tcccgtccttccacgtccttccac

SEQ ID NO: 1401 - DNA, 24 bp, Artificial Sequence
  Description of Artificial Sequence: Synthetic oligonucleotide
  5' Phos
tcccgtcgagcagtgtcgagcagt

SEQ ID NO: 1402 - DNA, 24 bp, Artificial Sequence
  Description of Artificial Sequence: Synthetic oligonucleotide
  5' Phos
tcccgtcgcacagagtcgcacaga

SEQ ID NO: 1403 - DNA, 24 bp, Artificial Sequence
  Description of Artificial Sequence: Synthetic oligonucleotide
  5' Phos
tcccgtcgcacttcgtcgcacttc

SEQ ID NO: 1404 - DNA, 24 bp, Artificial Sequence
  Description of Artificial Sequence: Synthetic oligonucleotide
  5' Phos
tcccgtctggtggtgtctggtggt

SEQ ID NO: 1405 - DNA, 24 bp, Artificial Sequence
  Description of Artificial Sequence: Synthetic oligonucleotide
  5' Phos
tcccgtgaactgttgtgaactgtt

SEQ ID NO: 1406 - DNA, 24 bp, Artificial Sequence
  Description of Artificial Sequence: Synthetic oligonucleotide
  5' Phos
tcccgtgccatcctgtgccatcct

SEQ ID NO: 1407 - DNA, 24 bp, Artificial Sequence
  Description of Artificial Sequence: Synthetic oligonucleotide
  5' Phos
tcccgtgcgtgaacgtgcgtgaac

SEQ ID NO: 1408 - DNA, 24 bp, Artificial Sequence
  Description of Artificial Sequence: Synthetic oligonucleotide
  5' Phos
tcccgtggagatgtgtggagatgt

SEQ ID NO: 1409 - DNA, 24 bp, Artificial Sequence
  Description of Artificial Sequence: Synthetic oligonucleotide
  5' Phos
tcccgtggtgcaacgtggtgcaac

SEQ ID NO: 1410 - DNA, 24 bp, Artificial Sequence
  Description of Artificial Sequence: Synthetic oligonucleotide
  5' Phos
tcccgtgtcgttaagtgtcgttaa

SEQ ID NO: 1411 - DNA, 24 bp, Artificial Sequence
  Description of Artificial Sequence: Synthetic oligonucleotide
  5' Phos
tcccgtgtctcaatgtgtctcaat

SEQ ID NO: 1412 - DNA, 24 bp, Artificial Sequence
  Description of Artificial Sequence: Synthetic oligonucleotide
  5' Phos
tcccgtgtgatgacgtgtgatgac

SEQ ID NO: 1413 - DNA, 24 bp, Artificial Sequence
  Description of Artificial Sequence: Synthetic oligonucleotide
  5' Phos
tcccgttagatcgcgttagatcgc

SEQ ID NO: 1414 - DNA, 24 bp, Artificial Sequence
  Description of Artificial Sequence: Synthetic oligonucleotide
  5' Phos
tccctaagccgatataagccgata

SEQ ID NO: 1415 - DNA, 24 bp, Artificial Sequence
  Description of Artificial Sequence: Synthetic oligonucleotide
  5' Phos
tccctaaggacacctaaggacacc

SEQ ID NO: 1416 - DNA, 24 bp, Artificial Sequence
  Description of Artificial Sequence: Synthetic oligonucleotide
  5' Phos
tccctaaggccaagtaaggccaag

SEQ ID NO: 1417 - DNA, 24 bp, Artificial Sequence
  Description of Artificial Sequence: Synthetic oligonucleotide
  5' Phos
tccctaatagcgagtaatagcgag

SEQ ID NO: 1418 - DNA, 24 bp, Artificial Sequence
  Description of Artificial Sequence: Synthetic oligonucleotide
  5' Phos
tccctaatggccggtaatggccgg

SEQ ID NO: 1419 - DNA, 24 bp, Artificial Sequence
  Description of Artificial Sequence: Synthetic oligonucleotide
  5' Phos
tccctaccattggataccattgga

SEQ ID NO: 1420 - DNA, 24 bp, Artificial Sequence
  Description of Artificial Sequence: Synthetic oligonucleotide
  5' Phos
tccctacgaccacctacgaccacc

SEQ ID NO: 1421 - DNA, 24 bp, Artificial Sequence
  Description of Artificial Sequence: Synthetic oligonucleotide
  5' Phos
tccctacgaccttatacgacctta

SEQ ID NO: 1422 - DNA, 24 bp, Artificial Sequence
  Description of Artificial Sequence: Synthetic oligonucleotide
  5' Phos
tccctacgtgattctacgtgattc

SEQ ID NO: 1423 - DNA, 24 bp, Artificial Sequence
  Description of Artificial Sequence: Synthetic oligonucleotide
  5' Phos
tccctactagtcagtactagtcag

SEQ ID NO: 1424 - DNA, 24 bp, Artificial Sequence
  Description of Artificial Sequence: Synthetic oligonucleotide
  5' Phos
tccctactgacaagtactgacaag

SEQ ID NO: 1425 - DNA, 24 bp, Artificial Sequence
  Description of Artificial Sequence: Synthetic oligonucleotide
  5' Phos
tccctactgctggctactgctggc

SEQ ID NO: 1426 - DNA, 24 bp, Artificial Sequence
  Description of Artificial Sequence: Synthetic oligonucleotide
  5' Phos
tccctagaccgtaatagaccgtaa

SEQ ID NO: 1427 - DNA, 24 bp, Artificial Sequence
  Description of Artificial Sequence: Synthetic oligonucleotide
  5' Phos
tccctagacgaagatagacgaaga

SEQ ID NO: 1428 - DNA, 24 bp, Artificial Sequence
  Description of Artificial Sequence: Synthetic oligonucleotide
  5' Phos
tccctagcctagcctagcctagcc

SEQ ID NO: 1429 - DNA, 24 bp, Artificial Sequence
  Description of Artificial Sequence: Synthetic oligonucleotide
  5' Phos
tccctagcgaattctagcgaattc

SEQ ID NO: 1430 - DNA, 24 bp, Artificial Sequence
  Description of Artificial Sequence: Synthetic oligonucleotide
  5' Phos
tccctagctgccactagctgccac

SEQ ID NO: 1431 - DNA, 24 bp, Artificial Sequence
  Description of Artificial Sequence: Synthetic oligonucleotide
  5' Phos
tccctaggtaggcataggtaggca

SEQ ID NO: 1432 - DNA, 24 bp, Artificial Sequence
  Description of Artificial Sequence: Synthetic oligonucleotide
  5' Phos
tccctagtcgttactagtcgttac

SEQ ID NO: 1433 - DNA, 24 bp, Artificial Sequence
  Description of Artificial Sequence: Synthetic oligonucleotide
  5' Phos
tccctagtgcgaagtagtgcgaag

SEQ ID NO: 1434 - DNA, 24 bp, Artificial Sequence
  Description of Artificial Sequence: Synthetic oligonucleotide
  5' Phos
tccctagtggacgctagtggacgc

SEQ ID NO: 1435 - DNA, 24 bp, Artificial Sequence
  Description of Artificial Sequence: Synthetic oligonucleotide
  5' Phos
tccctataacggtgtataacggtg

SEQ ID NO: 1436 - DNA, 24 bp, Artificial Sequence
  Description of Artificial Sequence: Synthetic oligonucleotide
  5' Phos
tccctatagaaccgtatagaaccg

SEQ ID NO: 1437 - DNA, 24 bp, Artificial Sequence
  Description of Artificial Sequence: Synthetic oligonucleotide
  5' Phos
tccctatccgaaggtatccgaagg

SEQ ID NO: 1438 - DNA, 24 bp, Artificial Sequence
  Description of Artificial Sequence: Synthetic oligonucleotide
  5' Phos
tccctatcggagcctatcggagcc

SEQ ID NO: 1439 - DNA, 24 bp, Artificial Sequence
  Description of Artificial Sequence: Synthetic oligonucleotide
  5' Phos
tccctatcggcctgtatcggcctg

SEQ ID NO: 1440 - DNA, 24 bp, Artificial Sequence
  Description of Artificial Sequence: Synthetic oligonucleotide
  5' Phos
tccctatcgtcggctatcgtcggc

SEQ ID NO: 1441 - DNA, 24 bp, Artificial Sequence
  Description of Artificial Sequence: Synthetic oligonucleotide
  5' Phos
tccctatgcgccactatgcgccac

SEQ ID NO: 1442 - DNA, 24 bp, Artificial Sequence
  Description of Artificial Sequence: Synthetic oligonucleotide
  5' Phos
tccctatggccgtctatggccgtc

SEQ ID NO: 1443 - DNA, 24 bp, Artificial Sequence
  Description of Artificial Sequence: Synthetic oligonucleotide
  5' Phos
tccctattcttccgtattcttccg

SEQ ID NO: 1444 - DNA, 24 bp, Artificial Sequence
  Description of Artificial Sequence: Synthetic oligonucleotide
  5' Phos
tccctcaagcaacgtcaagcaacg

SEQ ID NO: 1445 - DNA, 24 bp, Artificial Sequence
  Description of Artificial Sequence: Synthetic oligonucleotide
  5' Phos
tccctcaagcagtctcaagcagtc

SEQ ID NO: 1446 - DNA, 24 bp, Artificial Sequence
  Description of Artificial Sequence: Synthetic oligonucleotide
  5' Phos
tccctcaagtccgatcaagtccga

SEQ ID NO: 1447 - DNA, 24 bp, Artificial Sequence
  Description of Artificial Sequence: Synthetic oligonucleotide
  5' Phos
tccctcaatcgagatcaatcgaga

SEQ ID NO: 1448 - DNA, 24 bp, Artificial Sequence
  Description of Artificial Sequence: Synthetic oligonucleotide
  5' Phos
tccctcaatgtcgatcaatgtcga

SEQ ID NO: 1449 - DNA, 24 bp, Artificial Sequence
  Description of Artificial Sequence: Synthetic oligonucleotide
  5' Phos
tccctcactgaggctcactgaggc

SEQ ID NO: 1450 - DNA, 24 bp, Artificial Sequence
  Description of Artificial Sequence: Synthetic oligonucleotide
  5' Phos
tccctcagcgagactcagcgagac

SEQ ID NO: 1451 - DNA, 24 bp, Artificial Sequence
  Description of Artificial Sequence: Synthetic oligonucleotide
  5' Phos
tccctcaggaggaatcaggaggaa

SEQ ID NO: 1452 - DNA, 24 bp, Artificial Sequence
  Description of Artificial Sequence: Synthetic oligonucleotide
  5' Phos
tccctcaggcacagtcaggcacag

SEQ ID NO: 1453 - DNA, 24 bp, Artificial Sequence
  Description of Artificial Sequence: Synthetic oligonucleotide
  5' Phos
tccctcaggcttcctcaggcttcc

SEQ ID NO: 1454 - DNA, 24 bp, Artificial Sequence
  Description of Artificial Sequence: Synthetic oligonucleotide
  5' Phos
tccctccacactcgtccacactcg

SEQ ID NO: 1455 - DNA, 24 bp, Artificial Sequence
  Description of Artificial Sequence: Synthetic oligonucleotide
  5' Phos
tccctccacagcgatccacagcga

SEQ ID NO: 1456 - DNA, 24 bp, Artificial Sequence
  Description of Artificial Sequence: Synthetic oligonucleotide
  5' Phos
tccctccagctgcatccagctgca

SEQ ID NO: 1457 - DNA, 24 bp, Artificial Sequence
  Description of Artificial Sequence: Synthetic oligonucleotide
  5' Phos
tccctccataatcctccataatcc

SEQ ID NO: 1458 - DNA, 24 bp, Artificial Sequence
  Description of Artificial Sequence: Synthetic oligonucleotide
  5' Phos
tccctccggaccaatccggaccaa

SEQ ID NO: 1459 - DNA, 24 bp, Artificial Sequence
  Description of Artificial Sequence: Synthetic oligonucleotide
  5' Phos
tccctccgtaacggtccgtaacgg

SEQ ID NO: 1460 - DNA, 24 bp, Artificial Sequence
  Description of Artificial Sequence: Synthetic oligonucleotide
  5' Phos
tccctccgtaggtctccgtaggtc

SEQ ID NO: 1461 - DNA, 24 bp, Artificial Sequence
  Description of Artificial Sequence: Synthetic oligonucleotide
  5' Phos
tccctccgtccaagtccgtccaag

SEQ ID NO: 1462 - DNA, 24 bp, Artificial Sequence
  Description of Artificial Sequence: Synthetic oligonucleotide
  5' Phos
tccctcctgaaccgtcctgaaccg

SEQ ID NO: 1463 - DNA, 24 bp, Artificial Sequence
  Description of Artificial Sequence: Synthetic oligonucleotide
  5' Phos
tccctcctggcatgtcctggcatg

SEQ ID NO: 1464 - DNA, 24 bp, Artificial Sequence
  Description of Artificial Sequence: Synthetic oligonucleotide
  5' Phos
tccctcgcgctacatcgcgctaca

SEQ ID NO: 1465 - DNA, 24 bp, Artificial Sequence
  Description of Artificial Sequence: Synthetic oligonucleotide
  5' Phos
tccctcggttaccatcggttacca

SEQ ID NO: 1466 - DNA, 24 bp, Artificial Sequence
  Description of Artificial Sequence: Synthetic oligonucleotide
  5' Phos
tccctcgtccgtcatcgtccgtca

SEQ ID NO: 1467 - DNA, 24 bp, Artificial Sequence
  Description of Artificial Sequence: Synthetic oligonucleotide
  5' Phos
tccctcgtcctcagtcgtcctcag

SEQ ID NO: 1468 - DNA, 24 bp, Artificial Sequence
  Description of Artificial Sequence: Synthetic oligonucleotide
  5' Phos
tccctctaccgctctctaccgctc

SEQ ID NO: 1469 - DNA, 24 bp, Artificial Sequence
  Description of Artificial Sequence: Synthetic oligonucleotide
  5' Phos
tccctctagctcggtctagctcgg

SEQ ID NO: 1470 - DNA, 24 bp, Artificial Sequence
  Description of Artificial Sequence: Synthetic oligonucleotide
  5' Phos
tccctctcggctgatctcggctga

SEQ ID NO: 1471 - DNA, 24 bp, Artificial Sequence
  Description of Artificial Sequence: Synthetic oligonucleotide
  5' Phos
tccctctcggtcagtctcggtcag

SEQ ID NO: 1472 - DNA, 24 bp, Artificial Sequence
  Description of Artificial Sequence: Synthetic oligonucleotide
  5' Phos
tccctctctagatctctctagatc

SEQ ID NO: 1473 - DNA, 24 bp, Artificial Sequence
  Description of Artificial Sequence: Synthetic oligonucleotide
  5' Phos
tccctctgaccgcatctgaccgca

SEQ ID NO: 1474 - DNA, 24 bp, Artificial Sequence
  Description of Artificial Sequence: Synthetic oligonucleotide
  5' Phos
tccctctggacagatctggacaga

SEQ ID NO: 1475 - DNA, 24 bp, Artificial Sequence
  Description of Artificial Sequence: Synthetic oligonucleotide
  5' Phos
tccctctggataagtctggataag

SEQ ID NO: 1476 - DNA, 24 bp, Artificial Sequence
  Description of Artificial Sequence: Synthetic oligonucleotide
  5' Phos
tccctcttacggcctcttacggcc

SEQ ID NO: 1477 - DNA, 24 bp, Artificial Sequence
  Description of Artificial Sequence: Synthetic oligonucleotide
  5' Phos
tccctcttgcatactcttgcatac

SEQ ID NO: 1478 - DNA, 24 bp, Artificial Sequence
  Description of Artificial Sequence: Synthetic oligonucleotide
  5' Phos
tccctgaacttggatgaacttgga

SEQ ID NO: 1479 - DNA, 24 bp, Artificial Sequence
  Description of Artificial Sequence: Synthetic oligonucleotide
  5' Phos
tccctgacacagcgtgacacagcg

SEQ ID NO: 1480 - DNA, 24 bp, Artificial Sequence
  Description of Artificial Sequence: Synthetic oligonucleotide
  5' Phos
tccctgacaggtcctgacaggtcc

SEQ ID NO: 1481 - DNA, 24 bp, Artificial Sequence
  Description of Artificial Sequence: Synthetic oligonucleotide
  5' Phos
tccctgaccttccgtgaccttccg

SEQ ID NO: 1482 - DNA, 24 bp, Artificial Sequence
  Description of Artificial Sequence: Synthetic oligonucleotide
  5' Phos
tccctgacgtcggatgacgtcgga

SEQ ID NO: 1483 - DNA, 24 bp, Artificial Sequence
  Description of Artificial Sequence: Synthetic oligonucleotide
  5' Phos
tccctgactatctctgactatctc

SEQ ID NO: 1484 - DNA, 24 bp, Artificial Sequence
  Description of Artificial Sequence: Synthetic oligonucleotide
  5' Phos
tccctgactccaggtgactccagg

SEQ ID NO: 1485 - DNA, 24 bp, Artificial Sequence
  Description of Artificial Sequence: Synthetic oligonucleotide
  5' Phos
tccctgagagcaggtgagagcagg

SEQ ID NO: 1486 - DNA, 24 bp, Artificial Sequence
  Description of Artificial Sequence: Synthetic oligonucleotide
  5' Phos
tccctgagcctccatgagcctcca

SEQ ID NO: 1487 - DNA, 24 bp, Artificial Sequence
  Description of Artificial Sequence: Synthetic oligonucleotide
  5' Phos
tccctgagtatggatgagtatgga

SEQ ID NO: 1488 - DNA, 24 bp, Artificial Sequence
  Description of Artificial Sequence: Synthetic oligonucleotide
  5' Phos
tccctgcaacatactgcaacatac

SEQ ID NO: 1489 - DNA, 24 bp, Artificial Sequence
  Description of Artificial Sequence: Synthetic oligonucleotide
  5' Phos
tccctgcgctgtagtgcgctgtag

SEQ ID NO: 1490 - DNA, 24 bp, Artificial Sequence
  Description of Artificial Sequence: Synthetic oligonucleotide
  5' Phos
tccctgctaaccggtgctaaccgg

SEQ ID NO: 1491 - DNA, 24 bp, Artificial Sequence
  Description of Artificial Sequence: Synthetic oligonucleotide
  5' Phos
tccctgctccactgtgctccactg

SEQ ID NO: 1492 - DNA, 24 bp, Artificial Sequence
  Description of Artificial Sequence: Synthetic oligonucleotide
  5' Phos
tccctggaaggagctggaaggagc

SEQ ID NO: 1493 - DNA, 24 bp, Artificial Sequence
  Description of Artificial Sequence: Synthetic oligonucleotide
  5' Phos
tccctggcagtgactggcagtgac

SEQ ID NO: 1494 - DNA, 24 bp, Artificial Sequence
  Description of Artificial Sequence: Synthetic oligonucleotide
  5' Phos
tccctggcatcagctggcatcagc

SEQ ID NO: 1495 - DNA, 24 bp, Artificial Sequence
  Description of Artificial Sequence: Synthetic oligonucleotide
  5' Phos
tccctggccttatatggccttata

SEQ ID NO: 1496 - DNA, 24 bp, Artificial Sequence
  Description of Artificial Sequence: Synthetic oligonucleotide
  5' Phos
tccctggcgaagcatggcgaagca

SEQ ID NO: 1497 - DNA, 24 bp, Artificial Sequence
  Description of Artificial Sequence: Synthetic oligonucleotide
  5' Phos
tccctggcttaagatggcttaaga

SEQ ID NO: 1498 - DNA, 24 bp, Artificial Sequence
  Description of Artificial Sequence: Synthetic oligonucleotide
  5' Phos
tccctggtcagctctggtcagctc

SEQ ID NO: 1499 - DNA, 24 bp, Artificial Sequence
  Description of Artificial Sequence: Synthetic oligonucleotide
  5' Phos
tccctggttccaactggttccaac

SEQ ID NO: 1500 - DNA, 24 bp, Artificial Sequence
  Description of Artificial Sequence: Synthetic oligonucleotide
  5' Phos
tccctggttggtaatggttggtaa

SEQ ID NO: 1501 - DNA, 24 bp, Artificial Sequence
  Description of Artificial Sequence: Synthetic oligonucleotide
  5' Phos
tccctgtacgcgcatgtacgcgca

SEQ ID NO: 1502 - DNA, 24 bp, Artificial Sequence
  Description of Artificial Sequence: Synthetic oligonucleotide
  5' Phos
tccctgtacgctggtgtacgctgg

SEQ ID NO: 1503 - DNA, 24 bp, Artificial Sequence
  Description of Artificial Sequence: Synthetic oligonucleotide
  5' Phos
tccctgtagcattgtgtagcattg

SEQ ID NO: 1504 - DNA, 24 bp, Artificial Sequence
  Description of Artificial Sequence: Synthetic oligonucleotide
  5' Phos
tccctgtagtgccgtgtagtgccg

SEQ ID NO: 1505 - DNA, 24 bp, Artificial Sequence
  Description of Artificial Sequence: Synthetic oligonucleotide
  5' Phos
tccctgtgaatctgtgtgaatctg

SEQ ID NO: 1506 - DNA, 24 bp, Artificial Sequence
  Description of Artificial Sequence: Synthetic oligonucleotide
  5' Phos
tccctgttccgtggtgttccgtgg

SEQ ID NO: 1507 - DNA, 24 bp, Artificial Sequence
  Description of Artificial Sequence: Synthetic oligonucleotide
  5' Phos
tcccttagcgcgtgttagcgcgtg

SEQ ID NO: 1508 - DNA, 24 bp, Artificial Sequence
  Description of Artificial Sequence: Synthetic oligonucleotide
  5' Phos
tcccttagttggacttagttggac

SEQ ID NO: 1509 - DNA, 24 bp, Artificial Sequence
  Description of Artificial Sequence: Synthetic oligonucleotide
  5' Phos
tcccttccaacttcttccaacttc

SEQ ID NO: 1510 - DNA, 24 bp, Artificial Sequence
  Description of Artificial Sequence: Synthetic oligonucleotide
  5' Phos
tcccttccgtcaggttccgtcagg

SEQ ID NO: 1511 - DNA, 24 bp, Artificial Sequence
  Description of Artificial Sequence: Synthetic oligonucleotide
  5' Phos
tcccttcctcaccgttcctcaccg

SEQ ID NO: 1512 - DNA, 24 bp, Artificial Sequence
  Description of Artificial Sequence: Synthetic oligonucleotide
  5' Phos
tcccttcctccgacttcctccgac

SEQ ID NO: 1513 - DNA, 24 bp, Artificial Sequence
  Description of Artificial Sequence: Synthetic oligonucleotide
  5' Phos
tcccttcgacctggttcgacctgg

SEQ ID NO: 1514 - DNA, 24 bp, Artificial Sequence
  Description of Artificial Sequence: Synthetic oligonucleotide
  5' Phos
tcccttcgcgtggattcgcgtgga

SEQ ID NO: 1515 - DNA, 24 bp, Artificial Sequence
  Description of Artificial Sequence: Synthetic oligonucleotide
  5' Phos
tcccttcggaagcgttcggaagcg

SEQ ID NO: 1516 - DNA, 24 bp, Artificial Sequence
  Description of Artificial Sequence: Synthetic oligonucleotide
  5' Phos
tcccttctcgattgttctcgattg

SEQ ID NO: 1517 - DNA, 24 bp, Artificial Sequence
  Description of Artificial Sequence: Synthetic oligonucleotide
  5' Phos
tcccttctctctagttctctctag

SEQ ID NO: 1518 - DNA, 24 bp, Artificial Sequence
  Description of Artificial Sequence: Synthetic oligonucleotide
  5' Phos
tcccttcttgcgcgttcttgcgcg

SEQ ID NO: 1519 - DNA, 24 bp, Artificial Sequence
  Description of Artificial Sequence: Synthetic oligonucleotide
  5' Phos
tcccttgaggtcggttgaggtcgg

SEQ ID NO: 1520 - DNA, 24 bp, Artificial Sequence
  Description of Artificial Sequence: Synthetic oligonucleotide
  5' Phos
tcccttgcacacgcttgcacacgc

SEQ ID NO: 1521 - DNA, 24 bp, Artificial Sequence
  Description of Artificial Sequence: Synthetic oligonucleotide
  5' Phos
tcccttgcgctctgttgcgctctg

SEQ ID NO: 1522 - DNA, 24 bp, Artificial Sequence
  Description of Artificial Sequence: Synthetic oligonucleotide
  5' Phos
tcccttgctgcagcttgctgcagc

SEQ ID NO: 1523 - DNA, 24 bp, Artificial Sequence
  Description of Artificial Sequence: Synthetic oligonucleotide
  5' Phos
tcccttggcgtctgttggcgtctg

SEQ ID NO: 1524 - DNA, 24 bp, Artificial Sequence
  Description of Artificial Sequence: Synthetic oligonucleotide
  5' Phos
tcccttggtccttcttggtccttc

SEQ ID NO: 1525 - DNA, 24 bp, Artificial Sequence
  Description of Artificial Sequence: Synthetic oligonucleotide
  5' Phos
tcccttgtcgagagttgtcgagag

SEQ ID NO: 1526 - DNA, 24 bp, Artificial Sequence
  Description of Artificial Sequence: Synthetic oligonucleotide
  5' Phos
tcccttgtctgtacttgtctgtac

SEQ ID NO: 1527 - DNA, 24 bp, Artificial Sequence
  Description of Artificial Sequence: Synthetic oligonucleotide
  5' Phos
tcccttgttctctcttgttctctc

SEQ ID NO: 1528 - DNA, 24 bp, Artificial Sequence
  Description of Artificial Sequence: Synthetic oligonucleotide
  5' Phos
tcccaacacacgttaacacacgtt

SEQ ID NO: 1529 - DNA, 24 bp, Artificial Sequence
  Description of Artificial Sequence: Synthetic oligonucleotide
  5' Phos
tcccaacatcgagtaacatcgagt

SEQ ID NO: 1530 - DNA, 24 bp, Artificial Sequence
  Description of Artificial Sequence: Synthetic oligonucleotide
  5' Phos
tcccaaccgaggacaaccgaggac

SEQ ID NO: 1531 - DNA, 24 bp, Artificial Sequence
  Description of Artificial Sequence: Synthetic oligonucleotide
  5' Phos
tcccaacctagtagaacctagtag

SEQ ID NO: 1532 - DNA, 24 bp, Artificial Sequence
  Description of Artificial Sequence: Synthetic oligonucleotide
  5' Phos
tcccaacgcatactaacgcatact

SEQ ID NO: 1533 - DNA, 24 bp, Artificial Sequence
  Description of Artificial Sequence: Synthetic oligonucleotide
  5' Phos
tcccaactaacctcaactaacctc

SEQ ID NO: 1534 - DNA, 24 bp, Artificial Sequence
  Description of Artificial Sequence: Synthetic oligonucleotide
  5' Phos
tcccaactaaggagaactaaggag

SEQ ID NO: 1535 - DNA, 24 bp, Artificial Sequence
  Description of Artificial Sequence: Synthetic oligonucleotide
  5' Phos
tcccaactcgttctaactcgttct

SEQ ID NO: 1536 - DNA, 24 bp, Artificial Sequence
  Description of Artificial Sequence: Synthetic oligonucleotide
  5' Phos
tcccaactgccgctaactgccgct

SEQ ID NO: 1537 - DNA, 24 bp, Artificial Sequence
  Description of Artificial Sequence: Synthetic oligonucleotide
  5' Phos
cgaaacagatatccacagatatcc

SEQ ID NO: 1538 - DNA, 24 bp, Artificial Sequence
  Description of Artificial Sequence: Synthetic oligonucleotide
  5' Phos
cgaatatggcagcctatggcagcc

SEQ ID NO: 1539 - DNA, 24 bp, Artificial Sequence
  Description of Artificial Sequence: Synthetic oligonucleotide
  5' Phos
cgaattgacataccttgacatacc

SEQ ID NO: 1540 - DNA, 24 bp, Artificial Sequence
  Description of Artificial Sequence: Synthetic oligonucleotide
  5' Phos
cgaagtccttcaccgtccttcacc

SEQ ID NO: 1541 - DNA, 24 bp, Artificial Sequence
  Description of Artificial Sequence: Synthetic oligonucleotide
  5' Phos
cgaaatgctggtacatgctggtac

SEQ ID NO: 1542 - DNA, 24 bp, Artificial Sequence
  Description of Artificial Sequence: Synthetic oligonucleotide
  5' Phos
cgaaggatgtatacggatgtatac

SEQ ID NO: 1543 - DNA, 24 bp, Artificial Sequence
  Description of Artificial Sequence: Synthetic oligonucleotide
  5' Phos
cgaatgagcgatactgagcgatac

SEQ ID NO: 1544 - DNA, 24 bp, Artificial Sequence
  Description of Artificial Sequence: Synthetic oligonucleotide
  5' Phos
cgaatccatcggactccatcggac

SEQ ID NO: 1545 - DNA, 24 bp, Artificial Sequence
  Description of Artificial Sequence: Synthetic oligonucleotide
  5' Phos
cgaaaattccacacaattccacac

SEQ ID NO: 1546 - DNA, 24 bp, Artificial Sequence
  Description of Artificial Sequence: Synthetic oligonucleotide
  5' Phos
cgaatctgccacactctgccacac

SEQ ID NO: 1547 - DNA, 24 bp, Artificial Sequence
  Description of Artificial Sequence: Synthetic oligonucleotide
  5' Phos
cgaatcaccgtaactcaccgtaac

SEQ ID NO: 1548 - DNA, 24 bp, Artificial Sequence
  Description of Artificial Sequence: Synthetic oligonucleotide
  5' Phos
cgaaatgtacgaacatgtacgaac

SEQ ID NO: 1549 - DNA, 24 bp, Artificial Sequence
  Description of Artificial Sequence: Synthetic oligonucleotide
  5' Phos
cgaattaccggttattaccggtta

SEQ ID NO: 1550 - DNA, 24 bp, Artificial Sequence
  Description of Artificial Sequence: Synthetic oligonucleotide
  5' Phos
cgaatgactctgtatgactctgta

SEQ ID NO: 1551 - DNA, 24 bp, Artificial Sequence
  Description of Artificial Sequence: Synthetic oligonucleotide
  5' Phos
cgaatatctcggtatatctcggta

SEQ ID NO: 1552 - DNA, 24 bp, Artificial Sequence
  Description of Artificial Sequence: Synthetic oligonucleotide
  5' Phos
cgaagcgatgcgtagcgatgcgta

SEQ ID NO: 1553 - DNA, 24 bp, Artificial Sequence
  Description of Artificial Sequence: Synthetic oligonucleotide
  5' Phos
cgaacaagcgcgtacaagcgcgta

SEQ ID NO: 1554 - DNA, 24 bp, Artificial Sequence
  Description of Artificial Sequence: Synthetic oligonucleotide
  5' Phos
cgaagtgaagtctagtgaagtcta

SEQ ID NO: 1555 - DNA, 24 bp, Artificial Sequence
  Description of Artificial Sequence: Synthetic oligonucleotide
  5' Phos
cgaactaagcgatactaagcgata

SEQ ID NO: 1556 - DNA, 24 bp, Artificial Sequence
  Description of Artificial Sequence: Synthetic oligonucleotide
  5' Phos
cgaacggatcgtgacggatcgtga

SEQ ID NO: 1557 - DNA, 24 bp, Artificial Sequence
  Description of Artificial Sequence: Synthetic oligonucleotide
  5' Phos
cgaagcgaagctgagcgaagctga

SEQ ID NO: 1558 - DNA, 24 bp, Artificial Sequence
  Description of Artificial Sequence: Synthetic oligonucleotide
  5' Phos
cgaagaagtccggagaagtccgga

SEQ ID NO: 1559 - DNA, 24 bp, Artificial Sequence
  Description of Artificial Sequence: Synthetic oligonucleotide
  5' Phos
cgaaccataccggaccataccgga

SEQ ID NO: 1560 - DNA, 24 bp, Artificial Sequence
  Description of Artificial Sequence: Synthetic oligonucleotide
  5' Phos
cgaatcaccacggatcaccacgga

SEQ ID NO: 1561 - DNA, 24 bp, Artificial Sequence
  Description of Artificial Sequence: Synthetic oligonucleotide
  5' Phos
cgaatggatgaggatggatgagga

SEQ ID NO: 1562 - DNA, 24 bp, Artificial Sequence
  Description of Artificial Sequence: Synthetic oligonucleotide
  5' Phos
cgaatccagaaggatccagaagga

SEQ ID NO: 1563 - DNA, 24 bp, Artificial Sequence
  Description of Artificial Sequence: Synthetic oligonucleotide
  5' Phos
cgaagcaacagcgagcaacagcga

SEQ ID NO: 1564 - DNA, 24 bp, Artificial Sequence
  Description of Artificial Sequence: Synthetic oligonucleotide
  5' Phos
cgaacaagctccgacaagctccga

SEQ ID NO: 1565 - DNA, 24 bp, Artificial Sequence
  Description of Artificial Sequence: Synthetic oligonucleotide
  5' Phos
cgaactcatgccgactcatgccga

SEQ ID NO: 1566 - DNA, 24 bp, Artificial Sequence
  Description of Artificial Sequence: Synthetic oligonucleotide
  5' Phos
cgaagttccaccgagttccaccga

SEQ ID NO: 1567 - DNA, 24 bp, Artificial Sequence
  Description of Artificial Sequence: Synthetic oligonucleotide
  5' Phos
cgaattacaaccgattacaaccga

SEQ ID NO: 1568 - DNA, 24 bp, Artificial Sequence
  Description of Artificial Sequence: Synthetic oligonucleotide
  5' Phos
cgaatgccacacgatgccacacga

SEQ ID NO: 1569 - DNA, 24 bp, Artificial Sequence
  Description of Artificial Sequence: Synthetic oligonucleotide
  5' Phos
cgaagcggaacagagcggaacaga

SEQ ID NO: 1570 - DNA, 24 bp, Artificial Sequence
  Description of Artificial Sequence: Synthetic oligonucleotide
  5' Phos
cgaagacgccaagagacgccaaga

SEQ ID NO: 1571 - DNA, 24 bp, Artificial Sequence
  Description of Artificial Sequence: Synthetic oligonucleotide
  5' Phos
cgaagactcaatcagactcaatca

SEQ ID NO: 1572 - DNA, 24 bp, Artificial Sequence
  Description of Artificial Sequence: Synthetic oligonucleotide
  5' Phos
cgaatgccaacgcatgccaacgca

SEQ ID NO: 1573 - DNA, 24 bp, Artificial Sequence
  Description of Artificial Sequence: Synthetic oligonucleotide
  5' Phos
cgaacgcatgtccacgcatgtcca

SEQ ID NO: 1574 - DNA, 24 bp, Artificial Sequence
  Description of Artificial Sequence: Synthetic oligonucleotide
  5' Phos
cgaatggcttgccatggcttgcca

SEQ ID NO: 1575 - DNA, 24 bp, Artificial Sequence
  Description of Artificial Sequence: Synthetic oligonucleotide
  5' Phos
cgaacagttaaccacagttaacca

SEQ ID NO: 1576 - DNA, 24 bp, Artificial Sequence
  Description of Artificial Sequence: Synthetic oligonucleotide
  5' Phos
cgaactcaggtacactcaggtaca

SEQ ID NO: 1577 - DNA, 24 bp, Artificial Sequence
  Description of Artificial Sequence: Synthetic oligonucleotide
  5' Phos
cgaactgtagtacactgtagtaca

SEQ ID NO: 1578 - DNA, 24 bp, Artificial Sequence
  Description of Artificial Sequence: Synthetic oligonucleotide
  5' Phos
cgaagcaaccgacagcaaccgaca

SEQ ID NO: 1579 - DNA, 24 bp, Artificial Sequence
  Description of Artificial Sequence: Synthetic oligonucleotide
  5' Phos
cgaaccgacagacaccgacagaca

SEQ ID NO: 1580 - DNA, 24 bp, Artificial Sequence
  Description of Artificial Sequence: Synthetic oligonucleotide
  5' Phos
cgaagatagtcacagatagtcaca

SEQ ID NO: 1581 - DNA, 24 bp, Artificial Sequence
  Description of Artificial Sequence: Synthetic oligonucleotide
  5' Phos
cgaacgcactcacacgcactcaca

SEQ ID NO: 1582 - DNA, 24 bp, Artificial Sequence
  Description of Artificial Sequence: Synthetic oligonucleotide
  5' Phos
cgaagcgaaccacagcgaaccaca

SEQ ID NO: 1583 - DNA, 24 bp, Artificial Sequence
  Description of Artificial Sequence: Synthetic oligonucleotide
  5' Phos
cgaagtagagaacagtagagaaca

SEQ ID NO: 1584 - DNA, 24 bp, Artificial Sequence
  Description of Artificial Sequence: Synthetic oligonucleotide
  5' Phos
cgaagactggctaagactggctaa

SEQ ID NO: 1585 - DNA, 24 bp, Artificial Sequence
  Description of Artificial Sequence: Synthetic oligonucleotide
  5' Phos
cgaatattcgcgaatattcgcgaa

SEQ ID NO: 1586 - DNA, 24 bp, Artificial Sequence
  Description of Artificial Sequence: Synthetic oligonucleotide
  5' Phos
cgaagtaccgcgaagtaccgcgaa

SEQ ID NO: 1587 - DNA, 24 bp, Artificial Sequence
  Description of Artificial Sequence: Synthetic oligonucleotide
  5' Phos
cgaactgcatagaactgcatagaa

SEQ ID NO: 1588 - DNA, 24 bp, Artificial Sequence
  Description of Artificial Sequence: Synthetic oligonucleotide
  5' Phos
cgaatcggtaagaatcggtaagaa

SEQ ID NO: 1589 - DNA, 24 bp, Artificial Sequence
  Description of Artificial Sequence: Synthetic oligonucleotide
  5' Phos
cgaatccagagcaatccagagcaa

SEQ ID NO: 1590 - DNA, 24 bp, Artificial Sequence
  Description of Artificial Sequence: Synthetic oligonucleotide
  5' Phos
cgaaggtgttacaaggtgttacaa

SEQ ID NO: 1591 - DNA, 24 bp, Artificial Sequence
  Description of Artificial Sequence: Synthetic oligonucleotide
  5' Phos
cgaaggaacttgttggaacttgtt

SEQ ID NO: 1592 - DNA, 24 bp, Artificial Sequence
  Description of Artificial Sequence: Synthetic oligonucleotide
  5' Phos
cgaagcgtgctgttgcgtgctgtt

SEQ ID NO: 1593 - DNA, 24 bp, Artificial Sequence
  Description of Artificial Sequence: Synthetic oligonucleotide
  5' Phos
cgaaaccgcacgttaccgcacgtt

SEQ ID NO: 1594 - DNA, 24 bp, Artificial Sequence
  Description of Artificial Sequence: Synthetic oligonucleotide
  5' Phos
cgaacatcgctcttcatcgctctt

SEQ ID NO: 1595 - DNA, 24 bp, Artificial Sequence
  Description of Artificial Sequence: Synthetic oligonucleotide
  5' Phos
cgaaggaattccttggaattcctt

SEQ ID NO: 1596 - DNA, 24 bp, Artificial Sequence
  Description of Artificial Sequence: Synthetic oligonucleotide
  5' Phos
cgaacgcctcacttcgcctcactt

SEQ ID NO: 1597 - DNA, 24 bp, Artificial Sequence
  Description of Artificial Sequence: Synthetic oligonucleotide
  5' Phos
cgaaatcgcgtattatcgcgtatt

SEQ ID NO: 1598 - DNA, 24 bp, Artificial Sequence
  Description of Artificial Sequence: Synthetic oligonucleotide
  5' Phos
cgaaccaacctattccaacctatt

SEQ ID NO: 1599 - DNA, 24 bp, Artificial Sequence
  Description of Artificial Sequence: Synthetic oligonucleotide
  5' Phos
cgaaagcttcgattagcttcgatt

SEQ ID NO: 1600 - DNA, 24 bp, Artificial Sequence
  Description of Artificial Sequence: Synthetic oligonucleotide
  5' Phos
cgaaatcgtagtgtatcgtagtgt

SEQ ID NO: 1601 - DNA, 24 bp, Artificial Sequence
  Description of Artificial Sequence: Synthetic oligonucleotide
  5' Phos
cgaaggctgagtgtggctgagtgt

SEQ ID NO: 1602 - DNA, 24 bp, Artificial Sequence
  Description of Artificial Sequence: Synthetic oligonucleotide
  5' Phos
cgaaggctcgatgtggctcgatgt

SEQ ID NO: 1603 - DNA, 24 bp, Artificial Sequence
  Description of Artificial Sequence: Synthetic oligonucleotide
  5' Phos
cgaacgcataatgtcgcataatgt

SEQ ID NO: 1604 - DNA, 24 bp, Artificial Sequence
  Description of Artificial Sequence: Synthetic oligonucleotide
  5' Phos
cgaaagttgctggtagttgctggt

SEQ ID NO: 1605 - DNA, 24 bp, Artificial Sequence
  Description of Artificial Sequence: Synthetic oligonucleotide
  5' Phos
cgaacgtgttcggtcgtgttcggt

SEQ ID NO: 1606 - DNA, 24 bp, Artificial Sequence
  Description of Artificial Sequence: Synthetic oligonucleotide
  5' Phos
cgaaaccgttcggtaccgttcggt

SEQ ID NO: 1607 - DNA, 24 bp, Artificial Sequence
  Description of Artificial Sequence: Synthetic oligonucleotide
  5' Phos
cgaaagccactcgtagccactcgt

SEQ ID NO: 1608 - DNA, 24 bp, Artificial Sequence
  Description of Artificial Sequence: Synthetic oligonucleotide
  5' Phos
cgaaccgtaaccgtccgtaaccgt

SEQ ID NO: 1609 - DNA, 24 bp, Artificial Sequence
  Description of Artificial Sequence: Synthetic oligonucleotide
  5' Phos
cgaagcgcttacgtgcgcttacgt

SEQ ID NO: 1610 - DNA, 24 bp, Artificial Sequence
  Description of Artificial Sequence: Synthetic oligonucleotide
  5' Phos
cgaaagcacatagtagcacatagt

SEQ ID NO: 1611 - DNA, 24 bp, Artificial Sequence
  Description of Artificial Sequence: Synthetic oligonucleotide
  5' Phos
cgaaggactccagtggactccagt

SEQ ID NO: 1612 - DNA, 24 bp, Artificial Sequence
  Description of Artificial Sequence: Synthetic oligonucleotide
  5' Phos
cgaagaagtacagtgaagtacagt

SEQ ID NO: 1613 - DNA, 24 bp, Artificial Sequence
  Description of Artificial Sequence: Synthetic oligonucleotide
  5' Phos
cgaagcagacttctgcagacttct

SEQ ID NO: 1614 - DNA, 24 bp, Artificial Sequence
  Description of Artificial Sequence: Synthetic oligonucleotide
  5' Phos
cgaaactcgcgtctactcgcgtct

SEQ ID NO: 1615 - DNA, 24 bp, Artificial Sequence
  Description of Artificial Sequence: Synthetic oligonucleotide
  5' Phos
cgaaagcacagtctagcacagtct

SEQ ID NO: 1616 - DNA, 24 bp, Artificial Sequence
  Description of Artificial Sequence: Synthetic oligonucleotide
  5' Phos
cgaaggcgtactctggcgtactct

SEQ ID NO: 1617 - DNA, 24 bp, Artificial Sequence
  Description of Artificial Sequence: Synthetic oligonucleotide
  5' Phos
cgaacagtcgatctcagtcgatct

SEQ ID NO: 1618 - DNA, 24 bp, Artificial Sequence
  Description of Artificial Sequence: Synthetic oligonucleotide
  5' Phos
cgaaggccgaatctggccgaatct

SEQ ID NO: 1619 - DNA, 24 bp, Artificial Sequence
  Description of Artificial Sequence: Synthetic oligonucleotide
  5' Phos
cgaaagcacttgctagcacttgct

SEQ ID NO: 1620 - DNA, 24 bp, Artificial Sequence
  Description of Artificial Sequence: Synthetic oligonucleotide
  5' Phos
cgaacgcaatggctcgcaatggct

SEQ ID NO: 1621 - DNA, 24 bp, Artificial Sequence
  Description of Artificial Sequence: Synthetic oligonucleotide
  5' Phos
cgaaactgtccgctactgtccgct

SEQ ID NO: 1622 - DNA, 24 bp, Artificial Sequence
  Description of Artificial Sequence: Synthetic oligonucleotide
  5' Phos
cgaacgcttacgctcgcttacgct

SEQ ID NO: 1623 - DNA, 24 bp, Artificial Sequence
  Description of Artificial Sequence: Synthetic oligonucleotide
  5' Phos
cgaagagaatagctgagaatagct

SEQ ID NO: 1624 - DNA, 24 bp, Artificial Sequence
  Description of Artificial Sequence: Synthetic oligonucleotide
  5' Phos
cgaacgtataagctcgtataagct

SEQ ID NO: 1625 - DNA, 24 bp, Artificial Sequence
  Description of Artificial Sequence: Synthetic oligonucleotide
  5' Phos
cgaacatctgtcctcatctgtcct

SEQ ID NO: 1626 - DNA, 24 bp, Artificial Sequence
  Description of Artificial Sequence: Synthetic oligonucleotide
  5' Phos
cgaaatctgatcctatctgatcct

SEQ ID NO: 1627 - DNA, 24 bp, Artificial Sequence
  Description of Artificial Sequence: Synthetic oligonucleotide
  5' Phos
cgaaccttcagcctccttcagcct

SEQ ID NO: 1628 - DNA, 24 bp, Artificial Sequence
  Description of Artificial Sequence: Synthetic oligonucleotide
  5' Phos
cgaacctcgtacctcctcgtacct

SEQ ID NO: 1629 - DNA, 24 bp, Artificial Sequence
  Description of Artificial Sequence: Synthetic oligonucleotide
  5' Phos
cgaagagcctacctgagcctacct

SEQ ID NO: 1630 - DNA, 24 bp, Artificial Sequence
  Description of Artificial Sequence: Synthetic oligonucleotide
  5' Phos
cgaaccgttcacctccgttcacct

SEQ ID NO: 1631 - DNA, 24 bp, Artificial Sequence
  Description of Artificial Sequence: Synthetic oligonucleotide
  5' Phos
cgaaattggcacctattggcacct

SEQ ID NO: 1632 - DNA, 24 bp, Artificial Sequence
  Description of Artificial Sequence: Synthetic oligonucleotide
  5' Phos
cgaacgttgaacctcgttgaacct

SEQ ID NO: 1633 - DNA, 24 bp, Artificial Sequence
  Description of Artificial Sequence: Synthetic oligonucleotide
  5' Phos
cgaagcgagtgactgcgagtgact

SEQ ID NO: 1634 - DNA, 24 bp, Artificial Sequence
  Description of Artificial Sequence: Synthetic oligonucleotide
  5' Phos
cgaacaccacgactcaccacgact

SEQ ID NO: 1635 - DNA, 24 bp, Artificial Sequence
  Description of Artificial Sequence: Synthetic oligonucleotide
  5' Phos
cgaactcctccactctcctccact

SEQ ID NO: 1636 - DNA, 24 bp, Artificial Sequence
  Description of Artificial Sequence: Synthetic oligonucleotide
  5' Phos
cgaagcgctcaactgcgctcaact

SEQ ID NO: 1637 - DNA, 24 bp, Artificial Sequence
  Description of Artificial Sequence: Synthetic oligonucleotide
  5' Phos
cgaaaccatcaactaccatcaact

SEQ ID NO: 1638 - DNA, 24 bp, Artificial Sequence
  Description of Artificial Sequence: Synthetic oligonucleotide
  5' Phos
cgaagctgtgttatgctgtgttat

SEQ ID NO: 1639 - DNA, 24 bp, Artificial Sequence
  Description of Artificial Sequence: Synthetic oligonucleotide
  5' Phos
cgaacggaccttatcggaccttat

SEQ ID NO: 1640 - DNA, 24 bp, Artificial Sequence
  Description of Artificial Sequence: Synthetic oligonucleotide
  5' Phos
cgaactgactgtatctgactgtat

SEQ ID NO: 1641 - DNA, 24 bp, Artificial Sequence
  Description of Artificial Sequence: Synthetic oligonucleotide
  5' Phos
cgaaaggccggtataggccggtat

SEQ ID NO: 1642 - DNA, 24 bp, Artificial Sequence
  Description of Artificial Sequence: Synthetic oligonucleotide
  5' Phos
cgaaatcctgctatatcctgctat

SEQ ID NO: 1643 - DNA, 24 bp, Artificial Sequence
  Description of Artificial Sequence: Synthetic oligonucleotide
  5' Phos
cgaagtaacgctatgtaacgctat

SEQ ID NO: 1644 - DNA, 24 bp, Artificial Sequence
  Description of Artificial Sequence: Synthetic oligonucleotide
  5' Phos
cgaagttggactatgttggactat

SEQ ID NO: 1645 - DNA, 24 bp, Artificial Sequence
  Description of Artificial Sequence: Synthetic oligonucleotide
  5' Phos
cgaaccgccgatatccgccgatat

SEQ ID NO: 1646 - DNA, 24 bp, Artificial Sequence
  Description of Artificial Sequence: Synthetic oligonucleotide
  5' Phos
cgaacatcacggatcatcacggat

SEQ ID NO: 1647 - DNA, 24 bp, Artificial Sequence
  Description of Artificial Sequence: Synthetic oligonucleotide
  5' Phos
cgaaccggtacgatccggtacgat

SEQ ID NO: 1648 - DNA, 24 bp, Artificial Sequence
  Description of Artificial Sequence: Synthetic oligonucleotide
  5' Phos
cgaacagtaacgatcagtaacgat

SEQ ID NO: 1649 - DNA, 24 bp, Artificial Sequence
  Description of Artificial Sequence: Synthetic oligonucleotide
  5' Phos
cgaagcatcttcatgcatcttcat

SEQ ID NO: 1650 - DNA, 24 bp, Artificial Sequence
  Description of Artificial Sequence: Synthetic oligonucleotide
  5' Phos
cgaaaccacgccataccacgccat

SEQ ID NO: 1651 - DNA, 24 bp, Artificial Sequence
  Description of Artificial Sequence: Synthetic oligonucleotide
  5' Phos
cgaacgctcaacatcgctcaacat

SEQ ID NO: 1652 - DNA, 24 bp, Artificial Sequence
  Description of Artificial Sequence: Synthetic oligonucleotide
  5' Phos
cgaagacagctaatgacagctaat

SEQ ID NO: 1653 - DNA, 24 bp, Artificial Sequence
  Description of Artificial Sequence: Synthetic oligonucleotide
  5' Phos
cgaagcacgcgaatgcacgcgaat

SEQ ID NO: 1654 - DNA, 24 bp, Artificial Sequence
  Description of Artificial Sequence: Synthetic oligonucleotide
  5' Phos
cgaaggagcgcaatggagcgcaat

SEQ ID NO: 1655 - DNA, 24 bp, Artificial Sequence
  Description of Artificial Sequence: Synthetic oligonucleotide
  5' Phos
cgaagcaacacaatgcaacacaat

SEQ ID NO: 1656 - DNA, 24 bp, Artificial Sequence
  Description of Artificial Sequence: Synthetic oligonucleotide
  5' Phos
cgaaattcgtcttgattcgtcttg

SEQ ID NO: 1657 - DNA, 24 bp, Artificial Sequence
  Description of Artificial Sequence: Synthetic oligonucleotide
  5' Phos
cgaaacagtgcgtgacagtgcgtg

SEQ ID NO: 1658 - DNA, 24 bp, Artificial Sequence
  Description of Artificial Sequence: Synthetic oligonucleotide
  5' Phos
cgaactactccgtgctactccgtg

SEQ ID NO: 1659 - DNA, 24 bp, Artificial Sequence
  Description of Artificial Sequence: Synthetic oligonucleotide
  5' Phos
cgaacgataccgtgcgataccgtg

SEQ ID NO: 1660 - DNA, 24 bp, Artificial Sequence
  Description of Artificial Sequence: Synthetic oligonucleotide
  5' Phos
cgaaaatccgagtgaatccgagtg

SEQ ID NO: 1661 - DNA, 24 bp, Artificial Sequence
  Description of Artificial Sequence: Synthetic oligonucleotide
  5' Phos
cgaatactcaagtgtactcaagtg

SEQ ID NO: 1662 - DNA, 24 bp, Artificial Sequence
  Description of Artificial Sequence: Synthetic oligonucleotide
  5' Phos
cgaaactgaggctgactgaggctg

SEQ ID NO: 1663 - DNA, 24 bp, Artificial Sequence
  Description of Artificial Sequence: Synthetic oligonucleotide
  5' Phos
cgaacttggagctgcttggagctg

SEQ ID NO: 1664 - DNA, 24 bp, Artificial Sequence
  Description of Artificial Sequence: Synthetic oligonucleotide
  5' Phos
cgaactcctcgatgctcctcgatg

SEQ ID NO: 1665 - DNA, 24 bp, Artificial Sequence
  Description of Artificial Sequence: Synthetic oligonucleotide
  5' Phos
cgaaacggccaatgacggccaatg

SEQ ID NO: 1666 - DNA, 24 bp, Artificial Sequence
  Description of Artificial Sequence: Synthetic oligonucleotide
  5' Phos
cgaaccagttctggccagttctgg

SEQ ID NO: 1667 - DNA, 24 bp, Artificial Sequence
  Description of Artificial Sequence: Synthetic oligonucleotide
  5' Phos
cgaaccgtatctggccgtatctgg

SEQ ID NO: 1668 - DNA, 24 bp, Artificial Sequence
  Description of Artificial Sequence: Synthetic oligonucleotide
  5' Phos
cgaatggatcctggtggatcctgg

SEQ ID NO: 1669 - DNA, 24 bp, Artificial Sequence
  Description of Artificial Sequence: Synthetic oligonucleotide
  5' Phos
cgaaaacatcctggaacatcctgg

SEQ ID NO: 1670 - DNA, 24 bp, Artificial Sequence
  Description of Artificial Sequence: Synthetic oligonucleotide
  5' Phos
cgaaacatgctcggacatgctcgg

SEQ ID NO: 1671 - DNA, 24 bp, Artificial Sequence
  Description of Artificial Sequence: Synthetic oligonucleotide
  5' Phos
cgaaaacactccggaacactccgg

SEQ ID NO: 1672 - DNA, 24 bp, Artificial Sequence
  Description of Artificial Sequence: Synthetic oligonucleotide
  5' Phos
cgaaatggtaccggatggtaccgg

SEQ ID NO: 1673 - DNA, 24 bp, Artificial Sequence
  Description of Artificial Sequence: Synthetic oligonucleotide
  5' Phos
cgaaccttagacggccttagacgg

SEQ ID NO: 1674 - DNA, 24 bp, Artificial Sequence
  Description of Artificial Sequence: Synthetic oligonucleotide
  5' Phos
cgaattaatggaggttaatggagg

SEQ ID NO: 1675 - DNA, 24 bp, Artificial Sequence
  Description of Artificial Sequence: Synthetic oligonucleotide
  5' Phos
cgaaagtcaggaggagtcaggagg

SEQ ID NO: 1676 - DNA, 24 bp, Artificial Sequence
  Description of Artificial Sequence: Synthetic oligonucleotide
  5' Phos
cgaaagagcagaggagagcagagg

SEQ ID NO: 1677 - DNA, 24 bp, Artificial Sequence
  Description of Artificial Sequence: Synthetic oligonucleotide
  5' Phos
cgaaacaaggcaggacaaggcagg

SEQ ID NO: 1678 - DNA, 24 bp, Artificial Sequence
  Description of Artificial Sequence: Synthetic oligonucleotide
  5' Phos
cgaaaatggccaggaatggccagg

SEQ ID NO: 1679 - DNA, 24 bp, Artificial Sequence
  Description of Artificial Sequence: Synthetic oligonucleotide
  5' Phos
cgaacgcgttaaggcgcgttaagg

SEQ ID NO: 1680 - DNA, 24 bp, Artificial Sequence
  Description of Artificial Sequence: Synthetic oligonucleotide
  5' Phos
cgaaagacaggtcgagacaggtcg

SEQ ID NO: 1681 - DNA, 24 bp, Artificial Sequence
  Description of Artificial Sequence: Synthetic oligonucleotide
  5' Phos
cgaaacgtaacgcgacgtaacgcg

SEQ ID NO: 1682 - DNA, 24 bp, Artificial Sequence
  Description of Artificial Sequence: Synthetic oligonucleotide
  5' Phos
cgaatgaactgccgtgaactgccg

SEQ ID NO: 1683 - DNA, 24 bp, Artificial Sequence
  Description of Artificial Sequence: Synthetic oligonucleotide
  5' Phos
cgaactaatggccgctaatggccg

SEQ ID NO: 1684 - DNA, 24 bp, Artificial Sequence
  Description of Artificial Sequence: Synthetic oligonucleotide
  5' Phos
cgaaatgcaatacgatgcaatacg

SEQ ID NO: 1685 - DNA, 24 bp, Artificial Sequence
  Description of Artificial Sequence: Synthetic oligonucleotide
  5' Phos
cgaaacggtcgtagacggtcgtag

SEQ ID NO: 1686 - DNA, 24 bp, Artificial Sequence
  Description of Artificial Sequence: Synthetic oligonucleotide
  5' Phos
cgaaaccttcctagaccttcctag

SEQ ID NO: 1687 - DNA, 24 bp, Artificial Sequence
  Description of Artificial Sequence: Synthetic oligonucleotide
  5' Phos
cgaaacaggactagacaggactag

SEQ ID NO: 1688 - DNA, 24 bp, Artificial Sequence
  Description of Artificial Sequence: Synthetic oligonucleotide
  5' Phos
cgaacctccactagcctccactag

SEQ ID NO: 1689 - DNA, 24 bp, Artificial Sequence
  Description of Artificial Sequence: Synthetic oligonucleotide
  5' Phos
cgaaactctgcgagactctgcgag

SEQ ID NO: 1690 - DNA, 24 bp, Artificial Sequence
  Description of Artificial Sequence: Synthetic oligonucleotide
  5' Phos
cgaaacgaagcgagacgaagcgag

SEQ ID NO: 1691 - DNA, 24 bp, Artificial Sequence
  Description of Artificial Sequence: Synthetic oligonucleotide
  5' Phos
cgaacgctaacgagcgctaacgag

SEQ ID NO: 1692 - DNA, 24 bp, Artificial Sequence
  Description of Artificial Sequence: Synthetic oligonucleotide
  5' Phos
cgaacttggaagagcttggaagag

SEQ ID NO: 1693 - DNA, 24 bp, Artificial Sequence
  Description of Artificial Sequence: Synthetic oligonucleotide
  5' Phos
cgaaattgaagcagattgaagcag

SEQ ID NO: 1694 - DNA, 24 bp, Artificial Sequence
  Description of Artificial Sequence: Synthetic oligonucleotide
  5' Phos
cgaattgataccagttgataccag

SEQ ID NO: 1695 - DNA, 24 bp, Artificial Sequence
  Description of Artificial Sequence: Synthetic oligonucleotide
  5' Phos
cgaaccgaagacagccgaagacag

SEQ ID NO: 1696 - DNA, 24 bp, Artificial Sequence
  Description of Artificial Sequence: Synthetic oligonucleotide
  5' Phos
cgaacgtcatgaagcgtcatgaag

SEQ ID NO: 1697 - DNA, 24 bp, Artificial Sequence
  Description of Artificial Sequence: Synthetic oligonucleotide
  5' Phos
cgaaactgccgaagactgccgaag

SEQ ID NO: 1698 - DNA, 24 bp, Artificial Sequence
  Description of Artificial Sequence: Synthetic oligonucleotide
  5' Phos
cgaaaccggtcaagaccggtcaag

SEQ ID NO: 1699 - DNA, 24 bp, Artificial Sequence
  Description of Artificial Sequence: Synthetic oligonucleotide
  5' Phos
cgaaaataggcaagaataggcaag

SEQ ID NO: 1700 - DNA, 24 bp, Artificial Sequence
  Description of Artificial Sequence: Synthetic oligonucleotide
  5' Phos
cgaatcacaagttctcacaagttc

SEQ ID NO: 1701 - DNA, 24 bp, Artificial Sequence
  Description of Artificial Sequence: Synthetic oligonucleotide
  5' Phos
cgaaagaatgcttcagaatgcttc

SEQ ID NO: 1702 - DNA, 24 bp, Artificial Sequence
  Description of Artificial Sequence: Synthetic oligonucleotide
  5' Phos
cgaagaatggattcgaatggattc

SEQ ID NO: 1703 - DNA, 24 bp, Artificial Sequence
  Description of Artificial Sequence: Synthetic oligonucleotide
  5' Phos
cgaaaacaggcgtcaacaggcgtc

SEQ ID NO: 1704 - DNA, 24 bp, Artificial Sequence
  Description of Artificial Sequence: Synthetic oligonucleotide
  5' Phos
cgaagtcctacgtcgtcctacgtc

SEQ ID NO: 1705 - DNA, 24 bp, Artificial Sequence
  Description of Artificial Sequence: Synthetic oligonucleotide
  5' Phos
cgaaaccattagtcaccattagtc

SEQ ID NO: 1706 - DNA, 24 bp, Artificial Sequence
  Description of Artificial Sequence: Synthetic oligonucleotide
  5' Phos
cgaaaaggaggctcaaggaggctc

SEQ ID NO: 1707 - DNA, 24 bp, Artificial Sequence
  Description of Artificial Sequence: Synthetic oligonucleotide
  5' Phos
cgaagtagacgctcgtagacgctc

SEQ ID NO: 1708 - DNA, 24 bp, Artificial Sequence
  Description of Artificial Sequence: Synthetic oligonucleotide
  5' Phos
cgaagcctatcctcgcctatcctc

SEQ ID NO: 1709 - DNA, 24 bp, Artificial Sequence
  Description of Artificial Sequence: Synthetic oligonucleotide
  5' Phos
cgaagatggcactcgatggcactc

SEQ ID NO: 1710 - DNA, 24 bp, Artificial Sequence
  Description of Artificial Sequence: Synthetic oligonucleotide
  5' Phos
cgaaagatccactcagatccactc

SEQ ID NO: 1711 - DNA, 24 bp, Artificial Sequence
  Description of Artificial Sequence: Synthetic oligonucleotide
  5' Phos
cgaagctaccactcgctaccactc

SEQ ID NO: 1712 - DNA, 24 bp, Artificial Sequence
  Description of Artificial Sequence: Synthetic oligonucleotide
  5' Phos
cgaatctctaactctctctaactc

SEQ ID NO: 1713 - DNA, 24 bp, Artificial Sequence
  Description of Artificial Sequence: Synthetic oligonucleotide
  5' Phos
cgaagcagatgtgcgcagatgtgc

SEQ ID NO: 1714 - DNA, 24 bp, Artificial Sequence
  Description of Artificial Sequence: Synthetic oligonucleotide
  5' Phos
cgaagtaatggtgcgtaatggtgc

SEQ ID NO: 1715 - DNA, 24 bp, Artificial Sequence
  Description of Artificial Sequence: Synthetic oligonucleotide
  5' Phos
cgaaaataggctgcaataggctgc

SEQ ID NO: 1716 - DNA, 24 bp, Artificial Sequence
  Description of Artificial Sequence: Synthetic oligonucleotide
  5' Phos
cgaattgatactgcttgatactgc

SEQ ID NO: 1717 - DNA, 24 bp, Artificial Sequence
  Description of Artificial Sequence: Synthetic oligonucleotide
  5' Phos
cgaataacgacggctaacgacggc

SEQ ID NO: 1718 - DNA, 24 bp, Artificial Sequence
  Description of Artificial Sequence: Synthetic oligonucleotide
  5' Phos
cgaatagctcaggctagctcaggc

SEQ ID NO: 1719 - DNA, 24 bp, Artificial Sequence
  Description of Artificial Sequence: Synthetic oligonucleotide
  5' Phos
cgaattgcttgcgcttgcttgcgc

SEQ ID NO: 1720 - DNA, 24 bp, Artificial Sequence
  Description of Artificial Sequence: Synthetic oligonucleotide
  5' Phos
cgaagtcgtaacgcgtcgtaacgc

SEQ ID NO: 1721 - DNA, 24 bp, Artificial Sequence
  Description of Artificial Sequence: Synthetic oligonucleotide
  5' Phos
cgaagatccaacgcgatccaacgc

SEQ ID NO: 1722 - DNA, 24 bp, Artificial Sequence
  Description of Artificial Sequence: Synthetic oligonucleotide
  5' Phos
cgaatgcgactagctgcgactagc

SEQ ID NO: 1723 - DNA, 24 bp, Artificial Sequence
  Description of Artificial Sequence: Synthetic oligonucleotide
  5' Phos
cgaaggtagtgagcggtagtgagc

SEQ ID NO: 1724 - DNA, 24 bp, Artificial Sequence
  Description of Artificial Sequence: Synthetic oligonucleotide
  5' Phos
cgaataattcgagctaattcgagc

SEQ ID NO: 1725 - DNA, 24 bp, Artificial Sequence
  Description of Artificial Sequence: Synthetic oligonucleotide
  5' Phos
cgaaggaatcgagcggaatcgagc

SEQ ID NO: 1726 - DNA, 24 bp, Artificial Sequence
  Description of Artificial Sequence: Synthetic oligonucleotide
  5' Phos
cgaagatcctcagcgatcctcagc

SEQ ID NO: 1727 - DNA, 24 bp, Artificial Sequence
  Description of Artificial Sequence: Synthetic oligonucleotide
  5' Phos
cgaaagaatgaagcagaatgaagc

SEQ ID NO: 1728 - DNA, 24 bp, Artificial Sequence
  Description of Artificial Sequence: Synthetic oligonucleotide
  5' Phos
cgaaaatagcaagcaatagcaagc

SEQ ID NO: 1729 - DNA, 24 bp, Artificial Sequence
  Description of Artificial Sequence: Synthetic oligonucleotide
  5' Phos
gtcagcaaccaagcgcaaccaagc

SEQ ID NO: 1730 - DNA, 24 bp, Artificial Sequence
  Description of Artificial Sequence: Synthetic oligonucleotide
  5' Phos
gtcagaaccactccgaaccactcc

SEQ ID NO: 1731 - DNA, 24 bp, Artificial Sequence
  Description of Artificial Sequence: Synthetic oligonucleotide
  5' Phos
gtcaggtattatccggtattatcc

SEQ ID NO: 1732 - DNA, 24 bp, Artificial Sequence
  Description of Artificial Sequence: Synthetic oligonucleotide
  5' Phos
gtcaaccacgatccaccacgatcc

SEQ ID NO: 1733 - DNA, 24 bp, Artificial Sequence
  Description of Artificial Sequence: Synthetic oligonucleotide
  5' Phos
gtcaacaatcatccacaatcatcc

SEQ ID NO: 1734 - DNA, 24 bp, Artificial Sequence
  Description of Artificial Sequence: Synthetic oligonucleotide
  5' Phos
gtcagaacgcatccgaacgcatcc

SEQ ID NO: 1735 - DNA, 24 bp, Artificial Sequence
  Description of Artificial Sequence: Synthetic oligonucleotide
  5' Phos
gtcagacattcgccgacattcgcc

SEQ ID NO: 1736 - DNA, 24 bp, Artificial Sequence
  Description of Artificial Sequence: Synthetic oligonucleotide
  5' Phos
gtcaaccaatcgccaccaatcgcc

SEQ ID NO: 1737 - DNA, 24 bp, Artificial Sequence
  Description of Artificial Sequence: Synthetic oligonucleotide
  5' Phos
gtcatgataccgcctgataccgcc

SEQ ID NO: 1738 - DNA, 24 bp, Artificial Sequence
  Description of Artificial Sequence: Synthetic oligonucleotide
  5' Phos
gtcagtggatagccgtggatagcc

SEQ ID NO: 1739 - DNA, 24 bp, Artificial Sequence
  Description of Artificial Sequence: Synthetic oligonucleotide
  5' Phos
gtcatgtaatagcctgtaatagcc

SEQ ID NO: 1740 - DNA, 24 bp, Artificial Sequence
  Description of Artificial Sequence: Synthetic oligonucleotide
  5' Phos
gtcagagttcagccgagttcagcc

SEQ ID NO: 1741 - DNA, 24 bp, Artificial Sequence
  Description of Artificial Sequence: Synthetic oligonucleotide
  5' Phos
gtcatgactgtacctgactgtacc

SEQ ID NO: 1742 - DNA, 24 bp, Artificial Sequence
  Description of Artificial Sequence: Synthetic oligonucleotide
  5' Phos
gtcaaggttcgaccaggttcgacc

SEQ ID NO: 1743 - DNA, 24 bp, Artificial Sequence
  Description of Artificial Sequence: Synthetic oligonucleotide
  5' Phos
gtcaacgagagaccacgagagacc

SEQ ID NO: 1744 - DNA, 24 bp, Artificial Sequence
  Description of Artificial Sequence: Synthetic oligonucleotide
  5' Phos
gtcagacaagcaccgacaagcacc

SEQ ID NO: 1745 - DNA, 24 bp, Artificial Sequence
  Description of Artificial Sequence: Synthetic oligonucleotide
  5' Phos
gtcaaagtggaaccaagtggaacc

SEQ ID NO: 1746 - DNA, 24 bp, Artificial Sequence
  Description of Artificial Sequence: Synthetic oligonucleotide
  5' Phos
gtcaggatgcaaccggatgcaacc

SEQ ID NO: 1747 - DNA, 24 bp, Artificial Sequence
  Description of Artificial Sequence: Synthetic oligonucleotide
  5' Phos
gtcaacgtccaaccacgtccaacc

SEQ ID NO: 1748 - DNA, 24 bp, Artificial Sequence
  Description of Artificial Sequence: Synthetic oligonucleotide
  5' Phos
gtcattgctcttacttgctcttac

SEQ ID NO: 1749 - DNA, 24 bp, Artificial Sequence
  Description of Artificial Sequence: Synthetic oligonucleotide
  5' Phos
gtcataagccttactaagccttac

SEQ ID NO: 1750 - DNA, 24 bp, Artificial Sequence
  Description of Artificial Sequence: Synthetic oligonucleotide
  5' Phos
gtcatgaggactactgaggactac

SEQ ID NO: 1751 - DNA, 24 bp, Artificial Sequence
  Description of Artificial Sequence: Synthetic oligonucleotide
  5' Phos
gtcaagaaccggacagaaccggac

SEQ ID NO: 1752 - DNA, 24 bp, Artificial Sequence
  Description of Artificial Sequence: Synthetic oligonucleotide
  5' Phos
gtcagctgtaggacgctgtaggac

SEQ ID NO: 1753 - DNA, 24 bp, Artificial Sequence
  Description of Artificial Sequence: Synthetic oligonucleotide
  5' Phos
gtcattaatccgacttaatccgac

SEQ ID NO: 1754 - DNA, 24 bp, Artificial Sequence
  Description of Artificial Sequence: Synthetic oligonucleotide
  5' Phos
gtcattctgttcacttctgttcac

SEQ ID NO: 1755 - DNA, 24 bp, Artificial Sequence
  Description of Artificial Sequence: Synthetic oligonucleotide
  5' Phos
gtcagtgtaggcacgtgtaggcac

SEQ ID NO: 1756 - DNA, 24 bp, Artificial Sequence
  Description of Artificial Sequence: Synthetic oligonucleotide
  5' Phos
gtcatccgatacactccgatacac

SEQ ID NO: 1757 - DNA, 24 bp, Artificial Sequence
  Description of Artificial Sequence: Synthetic oligonucleotide
  5' Phos
gtcatcatggacactcatggacac

SEQ ID NO: 1758 - DNA, 24 bp, Artificial Sequence
  Description of Artificial Sequence: Synthetic oligonucleotide
  5' Phos
gtcagattagacacgattagacac

SEQ ID NO: 1759 - DNA, 24 bp, Artificial Sequence
  Description of Artificial Sequence: Synthetic oligonucleotide
  5' Phos
gtcagcaggaacacgcaggaacac

SEQ ID NO: 1760 - DNA, 24 bp, Artificial Sequence
  Description of Artificial Sequence: Synthetic oligonucleotide
  5' Phos
gtcaagcagaacacagcagaacac

SEQ ID NO: 1761 - DNA, 24 bp, Artificial Sequence
  Description of Artificial Sequence: Synthetic oligonucleotide
  5' Phos
gtcatcctcttaactcctcttaac

SEQ ID NO: 1762 - DNA, 24 bp, Artificial Sequence
  Description of Artificial Sequence: Synthetic oligonucleotide
  5' Phos
gtcaacgcattaacacgcattaac

SEQ ID NO: 1763 - DNA, 24 bp, Artificial Sequence
  Description of Artificial Sequence: Synthetic oligonucleotide
  5' Phos
gtcaacagcctaacacagcctaac

SEQ ID NO: 1764 - DNA, 24 bp, Artificial Sequence
  Description of Artificial Sequence: Synthetic oligonucleotide
  5' Phos
gtcatccaatgaactccaatgaac

SEQ ID NO: 1765 - DNA, 24 bp, Artificial Sequence
  Description of Artificial Sequence: Synthetic oligonucleotide
  5' Phos
gtcatggtccgaactggtccgaac

SEQ ID NO: 1766 - DNA, 24 bp, Artificial Sequence
  Description of Artificial Sequence: Synthetic oligonucleotide
  5' Phos
gtcaactggccaacactggccaac

SEQ ID NO: 1767 - DNA, 24 bp, Artificial Sequence
  Description of Artificial Sequence: Synthetic oligonucleotide
  5' Phos
gtcaaactaccaacaactaccaac

SEQ ID NO: 1768 - DNA, 24 bp, Artificial Sequence
  Description of Artificial Sequence: Synthetic oligonucleotide
  5' Phos
gtcatgtcgtgttatgtcgtgtta

SEQ ID NO: 1769 - DNA, 24 bp, Artificial Sequence
  Description of Artificial Sequence: Synthetic oligonucleotide
  5' Phos
gtcatgctctcttatgctctctta

SEQ ID NO: 1770 - DNA, 24 bp, Artificial Sequence
  Description of Artificial Sequence: Synthetic oligonucleotide
  5' Phos
gtcaccgcctcttaccgcctctta

SEQ ID NO: 1771 - DNA, 24 bp, Artificial Sequence
  Description of Artificial Sequence: Synthetic oligonucleotide
  5' Phos
gtcaccattccttaccattcctta

SEQ ID NO: 1772 - DNA, 24 bp, Artificial Sequence
  Description of Artificial Sequence: Synthetic oligonucleotide
  5' Phos
gtcagtgctcattagtgctcatta

SEQ ID NO: 1773 - DNA, 24 bp, Artificial Sequence
  Description of Artificial Sequence: Synthetic oligonucleotide
  5' Phos
gtcagaccagtgtagaccagtgta

SEQ ID NO: 1774 - DNA, 24 bp, Artificial Sequence
  Description of Artificial Sequence: Synthetic oligonucleotide
  5' Phos
gtcattgcgctgtattgcgctgta

SEQ ID NO: 1775 - DNA, 24 bp, Artificial Sequence
  Description of Artificial Sequence: Synthetic oligonucleotide
  5' Phos
gtcactaacctgtactaacctgta

SEQ ID NO: 1776 - DNA, 24 bp, Artificial Sequence
  Description of Artificial Sequence: Synthetic oligonucleotide
  5' Phos
gtcacggtaatgtacggtaatgta

SEQ ID NO: 1777 - DNA, 24 bp, Artificial Sequence
  Description of Artificial Sequence: Synthetic oligonucleotide
  5' Phos
gtcagagattggtagagattggta

SEQ ID NO: 1778 - DNA, 24 bp, Artificial Sequence
  Description of Artificial Sequence: Synthetic oligonucleotide
  5' Phos
gtcactctccggtactctccggta

SEQ ID NO: 1779 - DNA, 24 bp, Artificial Sequence
  Description of Artificial Sequence: Synthetic oligonucleotide
  5' Phos
gtcagaagccggtagaagccggta

SEQ ID NO: 1780 - DNA, 24 bp, Artificial Sequence
  Description of Artificial Sequence: Synthetic oligonucleotide
  5' Phos
gtcacatgtaggtacatgtaggta

SEQ ID NO: 1781 - DNA, 24 bp, Artificial Sequence
  Description of Artificial Sequence: Synthetic oligonucleotide
  5' Phos
gtcacgtaatcgtacgtaatcgta

SEQ ID NO: 1782 - DNA, 24 bp, Artificial Sequence
  Description of Artificial Sequence: Synthetic oligonucleotide
  5' Phos
gtcacctctgcgtacctctgcgta

SEQ ID NO: 1783 - DNA, 24 bp, Artificial Sequence
  Description of Artificial Sequence: Synthetic oligonucleotide
  5' Phos
gtcatcgttgagtatcgttgagta

SEQ ID NO: 1784 - DNA, 24 bp, Artificial Sequence
  Description of Artificial Sequence: Synthetic oligonucleotide
  5' Phos
gtcaggttggtctaggttggtcta

SEQ ID NO: 1785 - DNA, 24 bp, Artificial Sequence
  Description of Artificial Sequence: Synthetic oligonucleotide
  5' Phos
gtcacggaggtctacggaggtcta

SEQ ID NO: 1786 - DNA, 24 bp, Artificial Sequence
  Description of Artificial Sequence: Synthetic oligonucleotide
  5' Phos
gtcatcaactgctatcaactgcta

SEQ ID NO: 1787 - DNA, 24 bp, Artificial Sequence
  Description of Artificial Sequence: Synthetic oligonucleotide
  5' Phos
gtcagcttgcgctagcttgcgcta

SEQ ID NO: 1788 - DNA, 24 bp, Artificial Sequence
  Description of Artificial Sequence: Synthetic oligonucleotide
  5' Phos
gtcaggtatagctaggtatagcta

SEQ ID NO: 1789 - DNA, 24 bp, Artificial Sequence
  Description of Artificial Sequence: Synthetic oligonucleotide
  5' Phos
gtcagcgcaagctagcgcaagcta

SEQ ID NO: 1790 - DNA, 24 bp, Artificial Sequence
  Description of Artificial Sequence: Synthetic oligonucleotide
  5' Phos
gtcatggattcctatggattccta

SEQ ID NO: 1791 - DNA, 24 bp, Artificial Sequence
  Description of Artificial Sequence: Synthetic oligonucleotide
  5' Phos
gtcagaacggcctagaacggccta

SEQ ID NO: 1792 - DNA, 24 bp, Artificial Sequence
  Description of Artificial Sequence: Synthetic oligonucleotide
  5' Phos
gtcatagtgacctatagtgaccta

SEQ ID NO: 1793 - DNA, 24 bp, Artificial Sequence
  Description of Artificial Sequence: Synthetic oligonucleotide
  5' Phos
gtcagacgcgactagacgcgacta

SEQ ID NO: 1794 - DNA, 24 bp, Artificial Sequence
  Description of Artificial Sequence: Synthetic oligonucleotide
  5' Phos
gtcatagccgtatatagccgtata

SEQ ID NO: 1795 - DNA, 24 bp, Artificial Sequence
  Description of Artificial Sequence: Synthetic oligonucleotide
  5' Phos
gtcatgccgcgatatgccgcgata

SEQ ID NO: 1796 - DNA, 24 bp, Artificial Sequence
  Description of Artificial Sequence: Synthetic oligonucleotide
  5' Phos
gtcattgctccatattgctccata

SEQ ID NO: 1797 - DNA, 24 bp, Artificial Sequence
  Description of Artificial Sequence: Synthetic oligonucleotide
  5' Phos
gtcaccacgccataccacgccata

SEQ ID NO: 1798 - DNA, 24 bp, Artificial Sequence
  Description of Artificial Sequence: Synthetic oligonucleotide
  5' Phos
gtcacctgaacatacctgaacata

SEQ ID NO: 1799 - DNA, 24 bp, Artificial Sequence
  Description of Artificial Sequence: Synthetic oligonucleotide
  5' Phos
gtcagacaggaatagacaggaata

SEQ ID NO: 1800 - DNA, 24 bp, Artificial Sequence
  Description of Artificial Sequence: Synthetic oligonucleotide
  5' Phos
gtcagatctcttgagatctcttga

SEQ ID NO: 1801 - DNA, 24 bp, Artificial Sequence
  Description of Artificial Sequence: Synthetic oligonucleotide
  5' Phos
gtcattggtagtgattggtagtga

SEQ ID NO: 1802 - DNA, 24 bp, Artificial Sequence
  Description of Artificial Sequence: Synthetic oligonucleotide
  5' Phos
gtcacgcagactgacgcagactga

SEQ ID NO: 1803 - DNA, 24 bp, Artificial Sequence
  Description of Artificial Sequence: Synthetic oligonucleotide
  5' Phos
gtcagcttaactgagcttaactga

SEQ ID NO: 1804 - DNA, 24 bp, Artificial Sequence
  Description of Artificial Sequence: Synthetic oligonucleotide
  5' Phos
gtcaccactctggaccactctgga

SEQ ID NO: 1805 - DNA, 24 bp, Artificial Sequence
  Description of Artificial Sequence: Synthetic oligonucleotide
  5' Phos
gtcagacgactggagacgactgga

SEQ ID NO: 1806 - DNA, 24 bp, Artificial Sequence
  Description of Artificial Sequence: Synthetic oligonucleotide
  5' Phos
gtcacaacgtcggacaacgtcgga

SEQ ID NO: 1807 - DNA, 24 bp, Artificial Sequence
  Description of Artificial Sequence: Synthetic oligonucleotide
  5' Phos
gtcagtcggtaggagtcggtagga

SEQ ID NO: 1808 - DNA, 24 bp, Artificial Sequence
  Description of Artificial Sequence: Synthetic oligonucleotide
  5' Phos
gtcaggaggaaggaggaggaagga

SEQ ID NO: 1809 - DNA, 24 bp, Artificial Sequence
  Description of Artificial Sequence: Synthetic oligonucleotide
  5' Phos
gtcatggctctcgatggctctcga

SEQ ID NO: 1810 - DNA, 24 bp, Artificial Sequence
  Description of Artificial Sequence: Synthetic oligonucleotide
  5' Phos
gtcagtctgtgcgagtctgtgcga

SEQ ID NO: 1811 - DNA, 24 bp, Artificial Sequence
  Description of Artificial Sequence: Synthetic oligonucleotide
  5' Phos
gtcactaacggcgactaacggcga

SEQ ID NO: 1812 - DNA, 24 bp, Artificial Sequence
  Description of Artificial Sequence: Synthetic oligonucleotide
  5' Phos
gtcagttgtgccgagttgtgccga

SEQ ID NO: 1813 - DNA, 24 bp, Artificial Sequence
  Description of Artificial Sequence: Synthetic oligonucleotide
  5' Phos
gtcacaactgccgacaactgccga

SEQ ID NO: 1814 - DNA, 24 bp, Artificial Sequence
  Description of Artificial Sequence: Synthetic oligonucleotide
  5' Phos
gtcagtgtgaccgagtgtgaccga

SEQ ID NO: 1815 - DNA, 24 bp, Artificial Sequence
  Description of Artificial Sequence: Synthetic oligonucleotide
  5' Phos
gtcagctagcacgagctagcacga

SEQ ID NO: 1816 - DNA, 24 bp, Artificial Sequence
  Description of Artificial Sequence: Synthetic oligonucleotide
  5' Phos
gtcattaggctagattaggctaga

SEQ ID NO: 1817 - DNA, 24 bp, Artificial Sequence
  Description of Artificial Sequence: Synthetic oligonucleotide
  5' Phos
gtcacgcagtgagacgcagtgaga

SEQ ID NO: 1818 - DNA, 24 bp, Artificial Sequence
  Description of Artificial Sequence: Synthetic oligonucleotide
  5' Phos
gtcattgccggagattgccggaga

SEQ ID NO: 1819 - DNA, 24 bp, Artificial Sequence
  Description of Artificial Sequence: Synthetic oligonucleotide
  5' Phos
gtcagagagcgagagagagcgaga

SEQ ID NO: 1820 - DNA, 24 bp, Artificial Sequence
  Description of Artificial Sequence: Synthetic oligonucleotide
  5' Phos
gtcattgcgacagattgcgacaga

SEQ ID NO: 1821 - DNA, 24 bp, Artificial Sequence
  Description of Artificial Sequence: Synthetic oligonucleotide
  5' Phos
gtcagaggttaagagaggttaaga

SEQ ID NO: 1822 - DNA, 24 bp, Artificial Sequence
  Description of Artificial Sequence: Synthetic oligonucleotide
  5' Phos
gtcatcatgtgtcatcatgtgtca

SEQ ID NO: 1823 - DNA, 24 bp, Artificial Sequence
  Description of Artificial Sequence: Synthetic oligonucleotide
  5' Phos
gtcattcactctcattcactctca

SEQ ID NO: 1824 - DNA, 24 bp, Artificial Sequence
  Description of Artificial Sequence: Synthetic oligonucleotide
  5' Phos
gtcacagccactcacagccactca

SEQ ID NO: 1825 - DNA, 24 bp, Artificial Sequence
  Description of Artificial Sequence: Synthetic oligonucleotide
  5' Phos
gtcatggtcaatcatggtcaatca

SEQ ID NO: 1826 - DNA, 24 bp, Artificial Sequence
  Description of Artificial Sequence: Synthetic oligonucleotide
  5' Phos
gtcatgcgactgcatgcgactgca

SEQ ID NO: 1827 - DNA, 24 bp, Artificial Sequence
  Description of Artificial Sequence: Synthetic oligonucleotide
  5' Phos
gtcacctcatggcacctcatggca

SEQ ID NO: 1828 - DNA, 24 bp, Artificial Sequence
  Description of Artificial Sequence: Synthetic oligonucleotide
  5' Phos
gtcagcgttaggcagcgttaggca

SEQ ID NO: 1829 - DNA, 24 bp, Artificial Sequence
  Description of Artificial Sequence: Synthetic oligonucleotide
  5' Phos
gtcagttataggcagttataggca

SEQ ID NO: 1830 - DNA, 24 bp, Artificial Sequence
  Description of Artificial Sequence: Synthetic oligonucleotide
  5' Phos
gtcactctctcgcactctctcgca

SEQ ID NO: 1831 - DNA, 24 bp, Artificial Sequence
  Description of Artificial Sequence: Synthetic oligonucleotide
  5' Phos
gtcatgatcgcgcatgatcgcgca

SEQ ID NO: 1832 - DNA, 24 bp, Artificial Sequence
  Description of Artificial Sequence: Synthetic oligonucleotide
  5' Phos
gtcatcactccgcatcactccgca

SEQ ID NO: 1833 - DNA, 24 bp, Artificial Sequence
  Description of Artificial Sequence: Synthetic oligonucleotide
  5' Phos
gtcaggaatccgcaggaatccgca

SEQ ID NO: 1834 - DNA, 24 bp, Artificial Sequence
  Description of Artificial Sequence: Synthetic oligonucleotide
  5' Phos
gtcatgtagccgcatgtagccgca

SEQ ID NO: 1835 - DNA, 24 bp, Artificial Sequence
  Description of Artificial Sequence: Synthetic oligonucleotide
  5' Phos
gtcattgttacgcattgttacgca

SEQ ID NO: 1836 - DNA, 24 bp, Artificial Sequence
  Description of Artificial Sequence: Synthetic oligonucleotide
  5' Phos
gtcatgaggacgcatgaggacgca

SEQ ID NO: 1837 - DNA, 24 bp, Artificial Sequence
  Description of Artificial Sequence: Synthetic oligonucleotide
  5' Phos
gtcagctgaacgcagctgaacgca

SEQ ID NO: 1838 - DNA, 24 bp, Artificial Sequence
  Description of Artificial Sequence: Synthetic oligonucleotide
  5' Phos
gtcacgctgaagcacgctgaagca

SEQ ID NO: 1839 - DNA, 24 bp, Artificial Sequence
  Description of Artificial Sequence: Synthetic oligonucleotide
  5' Phos
gtcagaggcaagcagaggcaagca

SEQ ID NO: 1840 - DNA, 24 bp, Artificial Sequence
  Description of Artificial Sequence: Synthetic oligonucleotide
  5' Phos
gtcagccagttccagccagttcca

SEQ ID NO: 1841 - DNA, 24 bp, Artificial Sequence
  Description of Artificial Sequence: Synthetic oligonucleotide
  5' Phos
gtcactccaatacactccaataca

SEQ ID NO: 1842 - DNA, 24 bp, Artificial Sequence
  Description of Artificial Sequence: Synthetic oligonucleotide
  5' Phos
gtcaccgttccacaccgttccaca

SEQ ID NO: 1843 - DNA, 24 bp, Artificial Sequence
  Description of Artificial Sequence: Synthetic oligonucleotide
  5' Phos
gtcacgactccacacgactccaca

SEQ ID NO: 1844 - DNA, 24 bp, Artificial Sequence
  Description of Artificial Sequence: Synthetic oligonucleotide
  5' Phos
gtcatggccacacatggccacaca

SEQ ID NO: 1845 - DNA, 24 bp, Artificial Sequence
  Description of Artificial Sequence: Synthetic oligonucleotide
  5' Phos
gtcacctcttaacacctcttaaca

SEQ ID NO: 1846 - DNA, 24 bp, Artificial Sequence
  Description of Artificial Sequence: Synthetic oligonucleotide
  5' Phos
gtcagtgagtaacagtgagtaaca

SEQ ID NO: 1847 - DNA, 24 bp, Artificial Sequence
  Description of Artificial Sequence: Synthetic oligonucleotide
  5' Phos
gtcagctgcgaacagctgcgaaca

SEQ ID NO: 1848 - DNA, 24 bp, Artificial Sequence
  Description of Artificial Sequence: Synthetic oligonucleotide
  5' Phos
gtcatatgccaacatatgccaaca

SEQ ID NO: 1849 - DNA, 24 bp, Artificial Sequence
  Description of Artificial Sequence: Synthetic oligonucleotide
  5' Phos
gtcactgcacttaactgcacttaa

SEQ ID NO: 1850 - DNA, 24 bp, Artificial Sequence
  Description of Artificial Sequence: Synthetic oligonucleotide
  5' Phos
gtcaggatctctaaggatctctaa

SEQ ID NO: 1851 - DNA, 24 bp, Artificial Sequence
  Description of Artificial Sequence: Synthetic oligonucleotide
  5' Phos
gtcatctgacctaatctgacctaa

SEQ ID NO: 1852 - DNA, 24 bp, Artificial Sequence
  Description of Artificial Sequence: Synthetic oligonucleotide
  5' Phos
gtcacaggagataacaggagataa

SEQ ID NO: 1853 - DNA, 24 bp, Artificial Sequence
  Description of Artificial Sequence: Synthetic oligonucleotide
  5' Phos
gtcacgacactgaacgacactgaa

SEQ ID NO: 1854 - DNA, 24 bp, Artificial Sequence
  Description of Artificial Sequence: Synthetic oligonucleotide
  5' Phos
gtcacttcttggaacttcttggaa

SEQ ID NO: 1855 - DNA, 24 bp, Artificial Sequence
  Description of Artificial Sequence: Synthetic oligonucleotide
  5' Phos
gtcatgcggtggaatgcggtggaa

SEQ ID NO: 1856 - DNA, 24 bp, Artificial Sequence
  Description of Artificial Sequence: Synthetic oligonucleotide
  5' Phos
gtcagatagtggaagatagtggaa

SEQ ID NO: 1857 - DNA, 24 bp, Artificial Sequence
  Description of Artificial Sequence: Synthetic oligonucleotide
  5' Phos
gtcatcaagtggaatcaagtggaa

SEQ ID NO: 1858 - DNA, 24 bp, Artificial Sequence
  Description of Artificial Sequence: Synthetic oligonucleotide
  5' Phos
gtcagctctcggaagctctcggaa

SEQ ID NO: 1859 - DNA, 24 bp, Artificial Sequence
  Description of Artificial Sequence: Synthetic oligonucleotide
  5' Phos
gtcaggctcaggaaggctcaggaa

SEQ ID NO: 1860 - DNA, 24 bp, Artificial Sequence
  Description of Artificial Sequence: Synthetic oligonucleotide
  5' Phos
gtcagcgactcgaagcgactcgaa

SEQ ID NO: 1861 - DNA, 24 bp, Artificial Sequence
  Description of Artificial Sequence: Synthetic oligonucleotide
  5' Phos
gtcactggcacgaactggcacgaa

SEQ ID NO: 1862 - DNA, 24 bp, Artificial Sequence
  Description of Artificial Sequence: Synthetic oligonucleotide
  5' Phos
gtcatggtgtagaatggtgtagaa

SEQ ID NO: 1863 - DNA, 24 bp, Artificial Sequence
  Description of Artificial Sequence: Synthetic oligonucleotide
  5' Phos
gtcaggagcgagaaggagcgagaa

SEQ ID NO: 1864 - DNA, 24 bp, Artificial Sequence
  Description of Artificial Sequence: Synthetic oligonucleotide
  5' Phos
gtcagtggccagaagtggccagaa

SEQ ID NO: 1865 - DNA, 24 bp, Artificial Sequence
  Description of Artificial Sequence: Synthetic oligonucleotide
  5' Phos
gtcacaccattcaacaccattcaa

SEQ ID NO: 1866 - DNA, 24 bp, Artificial Sequence
  Description of Artificial Sequence: Synthetic oligonucleotide
  5' Phos
gtcagtcggctcaagtcggctcaa

SEQ ID NO: 1867 - DNA, 24 bp, Artificial Sequence
  Description of Artificial Sequence: Synthetic oligonucleotide
  5' Phos
gtcacttggcgcaacttggcgcaa

SEQ ID NO: 1868 - DNA, 24 bp, Artificial Sequence
  Description of Artificial Sequence: Synthetic oligonucleotide
  5' Phos
gtcactaagagcaactaagagcaa

SEQ ID NO: 1869 - DNA, 24 bp, Artificial Sequence
  Description of Artificial Sequence: Synthetic oligonucleotide
  5' Phos
gtcagccttgccaagccttgccaa

SEQ ID NO: 1870 - DNA, 24 bp, Artificial Sequence
  Description of Artificial Sequence: Synthetic oligonucleotide
  5' Phos
gtcacgtgagccaacgtgagccaa

SEQ ID NO: 1871 - DNA, 24 bp, Artificial Sequence
  Description of Artificial Sequence: Synthetic oligonucleotide
  5' Phos
gtcatggaagccaatggaagccaa

SEQ ID NO: 1872 - DNA, 24 bp, Artificial Sequence
  Description of Artificial Sequence: Synthetic oligonucleotide
  5' Phos
gtcagtatccacaagtatccacaa

SEQ ID NO: 1873 - DNA, 24 bp, Artificial Sequence
  Description of Artificial Sequence: Synthetic oligonucleotide
  5' Phos
gtcacatccgtgttcatccgtgtt

SEQ ID NO: 1874 - DNA, 24 bp, Artificial Sequence
  Description of Artificial Sequence: Synthetic oligonucleotide
  5' Phos
gtcaccggtctgttccggtctgtt

SEQ ID NO: 1875 - DNA, 24 bp, Artificial Sequence
  Description of Artificial Sequence: Synthetic oligonucleotide
  5' Phos
gtcagatcactgttgatcactgtt

SEQ ID NO: 1876 - DNA, 24 bp, Artificial Sequence
  Description of Artificial Sequence: Synthetic oligonucleotide
  5' Phos
gtcacaagatggttcaagatggtt

SEQ ID NO: 1877 - DNA, 24 bp, Artificial Sequence
  Description of Artificial Sequence: Synthetic oligonucleotide
  5' Phos
gtcacgtcaccgttcgtcaccgtt

SEQ ID NO: 1878 - DNA, 24 bp, Artificial Sequence
  Description of Artificial Sequence: Synthetic oligonucleotide
  5' Phos
gtcaccgcgtagttccgcgtagtt

SEQ ID NO: 1879 - DNA, 24 bp, Artificial Sequence
  Description of Artificial Sequence: Synthetic oligonucleotide
  5' Phos
gtcaaagcctagttaagcctagtt

SEQ ID NO: 1880 - DNA, 24 bp, Artificial Sequence
  Description of Artificial Sequence: Synthetic oligonucleotide
  5' Phos
gtcacacgccagttcacgccagtt

SEQ ID NO: 1881 - DNA, 24 bp, Artificial Sequence
  Description of Artificial Sequence: Synthetic oligonucleotide
  5' Phos
gtcaatcctgtcttatcctgtctt

SEQ ID NO: 1882 - DNA, 24 bp, Artificial Sequence
  Description of Artificial Sequence: Synthetic oligonucleotide
  5' Phos
gtcaactggctcttactggctctt

SEQ ID NO: 1883 - DNA, 24 bp, Artificial Sequence
  Description of Artificial Sequence: Synthetic oligonucleotide
  5' Phos
gtcacgatactcttcgatactctt

SEQ ID NO: 1884 - DNA, 24 bp, Artificial Sequence
  Description of Artificial Sequence: Synthetic oligonucleotide
  5' Phos
gtcaagtgttccttagtgttcctt

SEQ ID NO: 1885 - DNA, 24 bp, Artificial Sequence
  Description of Artificial Sequence: Synthetic oligonucleotide
  5' Phos
gtcacctgcgacttcctgcgactt

SEQ ID NO: 1886 - DNA, 24 bp, Artificial Sequence
  Description of Artificial Sequence: Synthetic oligonucleotide
  5' Phos
gtcagactgtgattgactgtgatt

SEQ ID NO: 1887 - DNA, 24 bp, Artificial Sequence
  Description of Artificial Sequence: Synthetic oligonucleotide
  5' Phos
gtcaaatggcgattaatggcgatt

SEQ ID NO: 1888 - DNA, 24 bp, Artificial Sequence
  Description of Artificial Sequence: Synthetic oligonucleotide
  5' Phos
gtcaggccgcaattggccgcaatt

SEQ ID NO: 1889 - DNA, 24 bp, Artificial Sequence
  Description of Artificial Sequence: Synthetic oligonucleotide
  5' Phos
gtcacgcgagttgtcgcgagttgt

SEQ ID NO: 1890 - DNA, 24 bp, Artificial Sequence
  Description of Artificial Sequence: Synthetic oligonucleotide
  5' Phos
gtcacgcagcttgtcgcagcttgt

SEQ ID NO: 1891 - DNA, 24 bp, Artificial Sequence
  Description of Artificial Sequence: Synthetic oligonucleotide
  5' Phos
gtcagaattggtgtgaattggtgt

SEQ ID NO: 1892 - DNA, 24 bp, Artificial Sequence
  Description of Artificial Sequence: Synthetic oligonucleotide
  5' Phos
gtcaaccttcgtgtaccttcgtgt

SEQ ID NO: 1893 - DNA, 24 bp, Artificial Sequence
  Description of Artificial Sequence: Synthetic oligonucleotide
  5' Phos
gtcacacattctgtcacattctgt

SEQ ID NO: 1894 - DNA, 24 bp, Artificial Sequence
  Description of Artificial Sequence: Synthetic oligonucleotide
  5' Phos
gtcaaccactatgtaccactatgt

SEQ ID NO: 1895 - DNA, 24 bp, Artificial Sequence
  Description of Artificial Sequence: Synthetic oligonucleotide
  5' Phos
gtcaacgtggtggtacgtggtggt

SEQ ID NO: 1896 - DNA, 24 bp, Artificial Sequence
  Description of Artificial Sequence: Synthetic oligonucleotide
  5' Phos
gtcaagctgtcggtagctgtcggt

SEQ ID NO: 1897 - DNA, 24 bp, Artificial Sequence
  Description of Artificial Sequence: Synthetic oligonucleotide
  5' Phos
gtcaactagccggtactagccggt

SEQ ID NO: 1898 - DNA, 24 bp, Artificial Sequence
  Description of Artificial Sequence: Synthetic oligonucleotide
  5' Phos
gtcaaatctacggtaatctacggt

SEQ ID NO: 1899 - DNA, 24 bp, Artificial Sequence
  Description of Artificial Sequence: Synthetic oligonucleotide
  5' Phos
gtcaaagtcacggtaagtcacggt

SEQ ID NO: 1900 - DNA, 24 bp, Artificial Sequence
  Description of Artificial Sequence: Synthetic oligonucleotide
  5' Phos
gtcagttgtgaggtgttgtgaggt

SEQ ID NO: 1901 - DNA, 24 bp, Artificial Sequence
  Description of Artificial Sequence: Synthetic oligonucleotide
  5' Phos
gtcaaggacaaggtaggacaaggt

SEQ ID NO: 1902 - DNA, 24 bp, Artificial Sequence
  Description of Artificial Sequence: Synthetic oligonucleotide
  5' Phos
gtcacctgcttcgtcctgcttcgt

SEQ ID NO: 1903 - DNA, 24 bp, Artificial Sequence
  Description of Artificial Sequence: Synthetic oligonucleotide
  5' Phos
gtcagtccagtcgtgtccagtcgt

SEQ ID NO: 1904 - DNA, 24 bp, Artificial Sequence
  Description of Artificial Sequence: Synthetic oligonucleotide
  5' Phos
gtcactgctctcgtctgctctcgt

SEQ ID NO: 1905 - DNA, 24 bp, Artificial Sequence
  Description of Artificial Sequence: Synthetic oligonucleotide
  5' Phos
gtcacaacaggcgtcaacaggcgt

SEQ ID NO: 1906 - DNA, 24 bp, Artificial Sequence
  Description of Artificial Sequence: Synthetic oligonucleotide
  5' Phos
gtcagaagtcgcgtgaagtcgcgt

SEQ ID NO: 1907 - DNA, 24 bp, Artificial Sequence
  Description of Artificial Sequence: Synthetic oligonucleotide
  5' Phos
gtcaatcaatccgtatcaatccgt

SEQ ID NO: 1908 - DNA, 24 bp, Artificial Sequence
  Description of Artificial Sequence: Synthetic oligonucleotide
  5' Phos
gtcacatgagccgtcatgagccgt

SEQ ID NO: 1909 - DNA, 24 bp, Artificial Sequence
  Description of Artificial Sequence: Synthetic oligonucleotide
  5' Phos
gtcaatcttaccgtatcttaccgt

SEQ ID NO: 1910 - DNA, 24 bp, Artificial Sequence
  Description of Artificial Sequence: Synthetic oligonucleotide
  5' Phos
gtcagtgctaccgtgtgctaccgt

SEQ ID NO: 1911 - DNA, 24 bp, Artificial Sequence
  Description of Artificial Sequence: Synthetic oligonucleotide
  5' Phos
gtcacgaacaccgtcgaacaccgt

SEQ ID NO: 1912 - DNA, 24 bp, Artificial Sequence
  Description of Artificial Sequence: Synthetic oligonucleotide
  5' Phos
gtcaccatcgacgtccatcgacgt

SEQ ID NO: 1913 - DNA, 24 bp, Artificial Sequence
  Description of Artificial Sequence: Synthetic oligonucleotide
  5' Phos
gtcagtctgcacgtgtctgcacgt

SEQ ID NO: 1914 - DNA, 24 bp, Artificial Sequence
  Description of Artificial Sequence: Synthetic oligonucleotide
  5' Phos
gtcagctggaacgtgctggaacgt

SEQ ID NO: 1915 - DNA, 24 bp, Artificial Sequence
  Description of Artificial Sequence: Synthetic oligonucleotide
  5' Phos
gtcaacaagctagtacaagctagt

SEQ ID NO: 1916 - DNA, 24 bp, Artificial Sequence
  Description of Artificial Sequence: Synthetic oligonucleotide
  5' Phos
gtcagcgtcctagtgcgtcctagt

SEQ ID NO: 1917 - DNA, 24 bp, Artificial Sequence
  Description of Artificial Sequence: Synthetic oligonucleotide
  5' Phos
gtcaccaggtgagtccaggtgagt

SEQ ID NO: 1918 - DNA, 24 bp, Artificial Sequence
  Description of Artificial Sequence: Synthetic oligonucleotide
  5' Phos
gtcacgatatgagtcgatatgagt

SEQ ID NO: 1919 - DNA, 24 bp, Artificial Sequence
  Description of Artificial Sequence: Synthetic oligonucleotide
  5' Phos
gtcacacggtcagtcacggtcagt

SEQ ID NO: 1920 - DNA, 24 bp, Artificial Sequence
  Description of Artificial Sequence: Synthetic oligonucleotide
  5' Phos
gtcaggttagaagtggttagaagt

SEQ ID NO: 1921 - DNA, 24 bp, Artificial Sequence
  Description of Artificial Sequence: Synthetic oligonucleotide
  5' Phos
gggaagcgccaagtagcgccaagt

SEQ ID NO: 1922 - DNA, 24 bp, Artificial Sequence
  Description of Artificial Sequence: Synthetic oligonucleotide
  5' Phos
gggaggagcgttctggagcgttct

SEQ ID NO: 1923 - DNA, 24 bp, Artificial Sequence
  Description of Artificial Sequence: Synthetic oligonucleotide
  5' Phos
gggacctaagttctcctaagttct

SEQ ID NO: 1924 - DNA, 24 bp, Artificial Sequence
  Description of Artificial Sequence: Synthetic oligonucleotide
  5' Phos
gggaatgcgcttctatgcgcttct

SEQ ID NO: 1925 - DNA, 24 bp, Artificial Sequence
  Description of Artificial Sequence: Synthetic oligonucleotide
  5' Phos
gggagctattgtctgctattgtct

SEQ ID NO: 1926 - DNA, 24 bp, Artificial Sequence
  Description of Artificial Sequence: Synthetic oligonucleotide
  5' Phos
gggagtctcggtctgtctcggtct

SEQ ID NO: 1927 - DNA, 24 bp, Artificial Sequence
  Description of Artificial Sequence: Synthetic oligonucleotide
  5' Phos
gggagacagcgtctgacagcgtct

SEQ ID NO: 1928 - DNA, 24 bp, Artificial Sequence
  Description of Artificial Sequence: Synthetic oligonucleotide
  5' Phos
gggacgctacgtctcgctacgtct

SEQ ID NO: 1929 - DNA, 24 bp, Artificial Sequence
  Description of Artificial Sequence: Synthetic oligonucleotide
  5' Phos
gggaagagctctctagagctctct

SEQ ID NO: 1930 - DNA, 24 bp, Artificial Sequence
  Description of Artificial Sequence: Synthetic oligonucleotide
  5' Phos
gggaagtggcctctagtggcctct

SEQ ID NO: 1931 - DNA, 24 bp, Artificial Sequence
  Description of Artificial Sequence: Synthetic oligonucleotide
  5' Phos
gggagcggcaatctgcggcaatct

SEQ ID NO: 1932 - DNA, 24 bp, Artificial Sequence
  Description of Artificial Sequence: Synthetic oligonucleotide
  5' Phos
gggagcatcgtgctgcatcgtgct

SEQ ID NO: 1933 - DNA, 24 bp, Artificial Sequence
  Description of Artificial Sequence: Synthetic oligonucleotide
  5' Phos
gggaattctctgctattctctgct

SEQ ID NO: 1934 - DNA, 24 bp, Artificial Sequence
  Description of Artificial Sequence: Synthetic oligonucleotide
  5' Phos
gggaccttgtggctccttgtggct

SEQ ID NO: 1935 - DNA, 24 bp, Artificial Sequence
  Description of Artificial Sequence: Synthetic oligonucleotide
  5' Phos
gggacttcctggctcttcctggct

SEQ ID NO: 1936 - DNA, 24 bp, Artificial Sequence
  Description of Artificial Sequence: Synthetic oligonucleotide
  5' Phos
gggactccagagctctccagagct

SEQ ID NO: 1937 - DNA, 24 bp, Artificial Sequence
  Description of Artificial Sequence: Synthetic oligonucleotide
  5' Phos
gggactgccaagctctgccaagct

SEQ ID NO: 1938 - DNA, 24 bp, Artificial Sequence
  Description of Artificial Sequence: Synthetic oligonucleotide
  5' Phos
gggacgttattcctcgttattcct

SEQ ID NO: 1939 - DNA, 24 bp, Artificial Sequence
  Description of Artificial Sequence: Synthetic oligonucleotide
  5' Phos
gggagtcaattcctgtcaattcct

SEQ ID NO: 1940 - DNA, 24 bp, Artificial Sequence
  Description of Artificial Sequence: Synthetic oligonucleotide
  5' Phos
gggaaattcctcctaattcctcct

SEQ ID NO: 1941 - DNA, 24 bp, Artificial Sequence
  Description of Artificial Sequence: Synthetic oligonucleotide
  5' Phos
gggaggcctatcctggcctatcct

SEQ ID NO: 1942 - DNA, 24 bp, Artificial Sequence
  Description of Artificial Sequence: Synthetic oligonucleotide
  5' Phos
gggaaaggccacctaaggccacct

SEQ ID NO: 1943 - DNA, 24 bp, Artificial Sequence
  Description of Artificial Sequence: Synthetic oligonucleotide
  5' Phos
gggacgcaacacctcgcaacacct

SEQ ID NO: 1944 - DNA, 24 bp, Artificial Sequence
  Description of Artificial Sequence: Synthetic oligonucleotide
  5' Phos
gggacacctaacctcacctaacct

SEQ ID NO: 1945 - DNA, 24 bp, Artificial Sequence
  Description of Artificial Sequence: Synthetic oligonucleotide
  5' Phos
gggaaggacggactaggacggact

SEQ ID NO: 1946 - DNA, 24 bp, Artificial Sequence
  Description of Artificial Sequence: Synthetic oligonucleotide
  5' Phos
gggacggatcgactcggatcgact

SEQ ID NO: 1947 - DNA, 24 bp, Artificial Sequence
  Description of Artificial Sequence: Synthetic oligonucleotide
  5' Phos
gggaagcagcgactagcagcgact

SEQ ID NO: 1948 - DNA, 24 bp, Artificial Sequence
  Description of Artificial Sequence: Synthetic oligonucleotide
  5' Phos
gggagaggacgactgaggacgact

SEQ ID NO: 1949 - DNA, 24 bp, Artificial Sequence
  Description of Artificial Sequence: Synthetic oligonucleotide
  5' Phos
gggaacggaacactacggaacact

SEQ ID NO: 1950 - DNA, 24 bp, Artificial Sequence
  Description of Artificial Sequence: Synthetic oligonucleotide
  5' Phos
gggaatgagcaactatgagcaact

SEQ ID NO: 1951 - DNA, 24 bp, Artificial Sequence
  Description of Artificial Sequence: Synthetic oligonucleotide
  5' Phos
gggactcacgttatctcacgttat

SEQ ID NO: 1952 - DNA, 24 bp, Artificial Sequence
  Description of Artificial Sequence: Synthetic oligonucleotide
  5' Phos
gggagcctgcgtatgcctgcgtat

SEQ ID NO: 1953 - DNA, 24 bp, Artificial Sequence
  Description of Artificial Sequence: Synthetic oligonucleotide
  5' Phos
gggagcatcagtatgcatcagtat

SEQ ID NO: 1954 - DNA, 24 bp, Artificial Sequence
  Description of Artificial Sequence: Synthetic oligonucleotide
  5' Phos
gggagacgaactatgacgaactat

SEQ ID NO: 1955 - DNA, 24 bp, Artificial Sequence
  Description of Artificial Sequence: Synthetic oligonucleotide
  5' Phos
gggagcgaagatatgcgaagatat

SEQ ID NO: 1956 - DNA, 24 bp, Artificial Sequence
  Description of Artificial Sequence: Synthetic oligonucleotide
  5' Phos
gggagaaggcatatgaaggcatat

SEQ ID NO: 1957 - DNA, 24 bp, Artificial Sequence
  Description of Artificial Sequence: Synthetic oligonucleotide
  5' Phos
gggagtgatctgatgtgatctgat

SEQ ID NO: 1958 - DNA, 24 bp, Artificial Sequence
  Description of Artificial Sequence: Synthetic oligonucleotide
  5' Phos
gggacagattggatcagattggat

SEQ ID NO: 1959 - DNA, 24 bp, Artificial Sequence
  Description of Artificial Sequence: Synthetic oligonucleotide
  5' Phos
gggacgctgtggatcgctgtggat

SEQ ID NO: 1960 - DNA, 24 bp, Artificial Sequence
  Description of Artificial Sequence: Synthetic oligonucleotide
  5' Phos
gggacgttccggatcgttccggat

SEQ ID NO: 1961 - DNA, 24 bp, Artificial Sequence
  Description of Artificial Sequence: Synthetic oligonucleotide
  5' Phos
gggaggaagccgatggaagccgat

SEQ ID NO: 1962 - DNA, 24 bp, Artificial Sequence
  Description of Artificial Sequence: Synthetic oligonucleotide
  5' Phos
gggactccgacgatctccgacgat

SEQ ID NO: 1963 - DNA, 24 bp, Artificial Sequence
  Description of Artificial Sequence: Synthetic oligonucleotide
  5' Phos
gggacgtgagagatcgtgagagat

SEQ ID NO: 1964 - DNA, 24 bp, Artificial Sequence
  Description of Artificial Sequence: Synthetic oligonucleotide
  5' Phos
gggagcaggtgcatgcaggtgcat

SEQ ID NO: 1965 - DNA, 24 bp, Artificial Sequence
  Description of Artificial Sequence: Synthetic oligonucleotide
  5' Phos
gggagcgactgcatgcgactgcat

SEQ ID NO: 1966 - DNA, 24 bp, Artificial Sequence
  Description of Artificial Sequence: Synthetic oligonucleotide
  5' Phos
gggacctacggcatcctacggcat

SEQ ID NO: 1967 - DNA, 24 bp, Artificial Sequence
  Description of Artificial Sequence: Synthetic oligonucleotide
  5' Phos
gggagatcgcgcatgatcgcgcat

SEQ ID NO: 1968 - DNA, 24 bp, Artificial Sequence
  Description of Artificial Sequence: Synthetic oligonucleotide
  5' Phos
gggaatcaccacatatcaccacat

SEQ ID NO: 1969 - DNA, 24 bp, Artificial Sequence
  Description of Artificial Sequence: Synthetic oligonucleotide
  5' Phos
gggaggctcgtaatggctcgtaat

SEQ ID NO: 1970 - DNA, 24 bp, Artificial Sequence
  Description of Artificial Sequence: Synthetic oligonucleotide
  5' Phos
gggagccgtggaatgccgtggaat

SEQ ID NO: 1971 - DNA, 24 bp, Artificial Sequence
  Description of Artificial Sequence: Synthetic oligonucleotide
  5' Phos
gggagacgccgaatgacgccgaat

SEQ ID NO: 1972 - DNA, 24 bp, Artificial Sequence
  Description of Artificial Sequence: Synthetic oligonucleotide
  5' Phos
gggaggcttccaatggcttccaat

SEQ ID NO: 1973 - DNA, 24 bp, Artificial Sequence
  Description of Artificial Sequence: Synthetic oligonucleotide
  5' Phos
gggaggccgacaatggccgacaat

SEQ ID NO: 1974 - DNA, 24 bp, Artificial Sequence
  Description of Artificial Sequence: Synthetic oligonucleotide
  5' Phos
gggacaagcggttgcaagcggttg

SEQ ID NO: 1975 - DNA, 24 bp, Artificial Sequence
  Description of Artificial Sequence: Synthetic oligonucleotide
  5' Phos
gggaccaccagttgccaccagttg

SEQ ID NO: 1976 - DNA, 24 bp, Artificial Sequence
  Description of Artificial Sequence: Synthetic oligonucleotide
  5' Phos
gggacaccatcttgcaccatcttg

SEQ ID NO: 1977 - DNA, 24 bp, Artificial Sequence
  Description of Artificial Sequence: Synthetic oligonucleotide
  5' Phos
gggatcgaatcttgtcgaatcttg

SEQ ID NO: 1978 - DNA, 24 bp, Artificial Sequence
  Description of Artificial Sequence: Synthetic oligonucleotide
  5' Phos
gggactcgtgcttgctcgtgcttg

SEQ ID NO: 1979 - DNA, 24 bp, Artificial Sequence
  Description of Artificial Sequence: Synthetic oligonucleotide
  5' Phos
gggacacaggcttgcacaggcttg

SEQ ID NO: 1980 - DNA, 24 bp, Artificial Sequence
  Description of Artificial Sequence: Synthetic oligonucleotide
  5' Phos
gggacgtgagcttgcgtgagcttg

SEQ ID NO: 1981 - DNA, 24 bp, Artificial Sequence
  Description of Artificial Sequence: Synthetic oligonucleotide
  5' Phos
gggacgcaaccttgcgcaaccttg

SEQ ID NO: 1982 - DNA, 24 bp, Artificial Sequence
  Description of Artificial Sequence: Synthetic oligonucleotide
  5' Phos
gggacgtcgacttgcgtcgacttg

SEQ ID NO: 1983 - DNA, 24 bp, Artificial Sequence
  Description of Artificial Sequence: Synthetic oligonucleotide
  5' Phos
gggacttcgtggtgcttcgtggtg

SEQ ID NO: 1984 - DNA, 24 bp, Artificial Sequence
  Description of Artificial Sequence: Synthetic oligonucleotide
  5' Phos
gggaaatatcggtgaatatcggtg

SEQ ID NO: 1985 - DNA, 24 bp, Artificial Sequence
  Description of Artificial Sequence: Synthetic oligonucleotide
  5' Phos
gggattcgacggtgttcgacggtg

SEQ ID NO: 1986 - DNA, 24 bp, Artificial Sequence
  Description of Artificial Sequence: Synthetic oligonucleotide
  5' Phos
gggatgtcacggtgtgtcacggtg

SEQ ID NO: 1987 - DNA, 24 bp, Artificial Sequence
  Description of Artificial Sequence: Synthetic oligonucleotide
  5' Phos
gggatcagcaggtgtcagcaggtg

SEQ ID NO: 1988 - DNA, 24 bp, Artificial Sequence
  Description of Artificial Sequence: Synthetic oligonucleotide
  5' Phos
gggatatgtgcgtgtatgtgcgtg

SEQ ID NO: 1989 - DNA, 24 bp, Artificial Sequence
  Description of Artificial Sequence: Synthetic oligonucleotide
  5' Phos
gggaccttagcgtgccttagcgtg

SEQ ID NO: 1990 - DNA, 24 bp, Artificial Sequence
  Description of Artificial Sequence: Synthetic oligonucleotide
  5' Phos
gggaagattacgtgagattacgtg

SEQ ID NO: 1991 - DNA, 24 bp, Artificial Sequence
  Description of Artificial Sequence: Synthetic oligonucleotide
  5' Phos
gggaactccacgtgactccacgtg

SEQ ID NO: 1992 - DNA, 24 bp, Artificial Sequence
  Description of Artificial Sequence: Synthetic oligonucleotide
  5' Phos
gggactctcgagtgctctcgagtg

SEQ ID NO: 1993 - DNA, 24 bp, Artificial Sequence
  Description of Artificial Sequence: Synthetic oligonucleotide
  5' Phos
gggatcagagagtgtcagagagtg

SEQ ID NO: 1994 - DNA, 24 bp, Artificial Sequence
  Description of Artificial Sequence: Synthetic oligonucleotide
  5' Phos
gggaagccagagtgagccagagtg

SEQ ID NO: 1995 - DNA, 24 bp, Artificial Sequence
  Description of Artificial Sequence: Synthetic oligonucleotide
  5' Phos
gggacatggcagtgcatggcagtg

SEQ ID NO: 1996 - DNA, 24 bp, Artificial Sequence
  Description of Artificial Sequence: Synthetic oligonucleotide
  5' Phos
gggaagttcaagtgagttcaagtg

SEQ ID NO: 1997 - DNA, 24 bp, Artificial Sequence
  Description of Artificial Sequence: Synthetic oligonucleotide
  5' Phos
gggactcaggtctgctcaggtctg

SEQ ID NO: 1998 - DNA, 24 bp, Artificial Sequence
  Description of Artificial Sequence: Synthetic oligonucleotide
  5' Phos
gggaatgctcgctgatgctcgctg

SEQ ID NO: 1999 - DNA, 24 bp, Artificial Sequence
  Description of Artificial Sequence: Synthetic oligonucleotide
  5' Phos
gggacctcttcctgcctcttcctg

SEQ ID NO: 2000 - DNA, 24 bp, Artificial Sequence
  Description of Artificial Sequence: Synthetic oligonucleotide
  5' Phos
gggatatgagactgtatgagactg

SEQ ID NO: 2001 - DNA, 24 bp, Artificial Sequence
  Description of Artificial Sequence: Synthetic oligonucleotide
  5' Phos
gggatcgataactgtcgataactg

SEQ ID NO: 2002 - DNA, 24 bp, Artificial Sequence
  Description of Artificial Sequence: Synthetic oligonucleotide
  5' Phos
gggacgcgtgtatgcgcgtgtatg

SEQ ID NO: 2003 - DNA, 24 bp, Artificial Sequence
  Description of Artificial Sequence: Synthetic oligonucleotide
  5' Phos
gggacgtcggtatgcgtcggtatg

SEQ ID NO: 2004 - DNA, 24 bp, Artificial Sequence
  Description of Artificial Sequence: Synthetic oligonucleotide
  5' Phos
gggaaccattgatgaccattgatg

SEQ ID NO: 2005 - DNA, 24 bp, Artificial Sequence
  Description of Artificial Sequence: Synthetic oligonucleotide
  5' Phos
gggacggtgtcatgcggtgtcatg

SEQ ID NO: 2006 - DNA, 24 bp, Artificial Sequence
  Description of Artificial Sequence: Synthetic oligonucleotide
  5' Phos
gggaccgaaccatgccgaaccatg

SEQ ID NO: 2007 - DNA, 24 bp, Artificial Sequence
  Description of Artificial Sequence: Synthetic oligonucleotide
  5' Phos
gggacgctccaatgcgctccaatg

SEQ ID NO: 2008 - DNA, 24 bp, Artificial Sequence
  Description of Artificial Sequence: Synthetic oligonucleotide
  5' Phos
gggactctcgttggctctcgttgg

SEQ ID NO: 2009 - DNA, 24 bp, Artificial Sequence
  Description of Artificial Sequence: Synthetic oligonucleotide
  5' Phos
gggactggtcttggctggtcttgg

SEQ ID NO: 2010 - DNA, 24 bp, Artificial Sequence
  Description of Artificial Sequence: Synthetic oligonucleotide
  5' Phos
gggaccgtgattggccgtgattgg

SEQ ID NO: 2011 - DNA, 24 bp, Artificial Sequence
  Description of Artificial Sequence: Synthetic oligonucleotide
  5' Phos
gggaacaacggtggacaacggtgg

SEQ ID NO: 2012 - DNA, 24 bp, Artificial Sequence
  Description of Artificial Sequence: Synthetic oligonucleotide
  5' Phos
gggatccgatctggtccgatctgg

SEQ ID NO: 2013 - DNA, 24 bp, Artificial Sequence
  Description of Artificial Sequence: Synthetic oligonucleotide
  5' Phos
gggactgacttcggctgacttcgg

SEQ ID NO: 2014 - DNA, 24 bp, Artificial Sequence
  Description of Artificial Sequence: Synthetic oligonucleotide
  5' Phos
gggaacttcagcggacttcagcgg

SEQ ID NO: 2015 - DNA, 24 bp, Artificial Sequence
  Description of Artificial Sequence: Synthetic oligonucleotide
  5' Phos
gggatatggtccggtatggtccgg

SEQ ID NO: 2016 - DNA, 24 bp, Artificial Sequence
  Description of Artificial Sequence: Synthetic oligonucleotide
  5' Phos
gggacctagaacggcctagaacgg

SEQ ID NO: 2017 - DNA, 24 bp, Artificial Sequence
  Description of Artificial Sequence: Synthetic oligonucleotide
  5' Phos
gggaccgcattaggccgcattagg

SEQ ID NO: 2018 - DNA, 24 bp, Artificial Sequence
  Description of Artificial Sequence: Synthetic oligonucleotide
  5' Phos
gggatcgtcataggtcgtcatagg

SEQ ID NO: 2019 - DNA, 24 bp, Artificial Sequence
  Description of Artificial Sequence: Synthetic oligonucleotide
  5' Phos
gggaactggtgaggactggtgagg

SEQ ID NO: 2020 - DNA, 24 bp, Artificial Sequence
  Description of Artificial Sequence: Synthetic oligonucleotide
  5' Phos
gggacgtcttcaggcgtcttcagg

SEQ ID NO: 2021 - DNA, 24 bp, Artificial Sequence
  Description of Artificial Sequence: Synthetic oligonucleotide
  5' Phos
gggaaggagtcaggaggagtcagg

SEQ ID NO: 2022 - DNA, 24 bp, Artificial Sequence
  Description of Artificial Sequence: Synthetic oligonucleotide
  5' Phos
gggaccactcttcgccactcttcg

SEQ ID NO: 2023 - DNA, 24 bp, Artificial Sequence
  Description of Artificial Sequence: Synthetic oligonucleotide
  5' Phos
gggaaccaccttcgaccaccttcg

SEQ ID NO: 2024 - DNA, 24 bp, Artificial Sequence
  Description of Artificial Sequence: Synthetic oligonucleotide
  5' Phos
gggactgctagtcgctgctagtcg

SEQ ID NO: 2025 - DNA, 24 bp, Artificial Sequence
  Description of Artificial Sequence: Synthetic oligonucleotide
  5' Phos
gggatctcgagtcgtctcgagtcg

SEQ ID NO: 2026 - DNA, 24 bp, Artificial Sequence
  Description of Artificial Sequence: Synthetic oligonucleotide
  5' Phos
gggattgtaagtcgttgtaagtcg

SEQ ID NO: 2027 - DNA, 24 bp, Artificial Sequence
  Description of Artificial Sequence: Synthetic oligonucleotide
  5' Phos
gggattaatcctcgttaatcctcg

SEQ ID NO: 2028 - DNA, 24 bp, Artificial Sequence
  Description of Artificial Sequence: Synthetic oligonucleotide
  5' Phos
gggaacatgcctcgacatgcctcg

SEQ ID NO: 2029 - DNA, 24 bp, Artificial Sequence
  Description of Artificial Sequence: Synthetic oligonucleotide
  5' Phos
gggaagcagactcgagcagactcg

SEQ ID NO: 2030 - DNA, 24 bp, Artificial Sequence
  Description of Artificial Sequence: Synthetic oligonucleotide
  5' Phos
gggatgctcactcgtgctcactcg

SEQ ID NO: 2031 - DNA, 24 bp, Artificial Sequence
  Description of Artificial Sequence: Synthetic oligonucleotide
  5' Phos
gggacttccgatcgcttccgatcg

SEQ ID NO: 2032 - DNA, 24 bp, Artificial Sequence
  Description of Artificial Sequence: Synthetic oligonucleotide
  5' Phos
gggacggtagatcgcggtagatcg

SEQ ID NO: 2033 - DNA, 24 bp, Artificial Sequence
  Description of Artificial Sequence: Synthetic oligonucleotide
  5' Phos
gggaaagcttggcgaagcttggcg

SEQ ID NO: 2034 - DNA, 24 bp, Artificial Sequence
  Description of Artificial Sequence: Synthetic oligonucleotide
  5' Phos
gggaaattctggcgaattctggcg

SEQ ID NO: 2035 - DNA, 24 bp, Artificial Sequence
  Description of Artificial Sequence: Synthetic oligonucleotide
  5' Phos
gggatccattcgcgtccattcgcg

SEQ ID NO: 2036 - DNA, 24 bp, Artificial Sequence
  Description of Artificial Sequence: Synthetic oligonucleotide
  5' Phos
gggaaggatgagcgaggatgagcg

SEQ ID NO: 2037 - DNA, 24 bp, Artificial Sequence
  Description of Artificial Sequence: Synthetic oligonucleotide
  5' Phos
gggacattcgagcgcattcgagcg

SEQ ID NO: 2038 - DNA, 24 bp, Artificial Sequence
  Description of Artificial Sequence: Synthetic oligonucleotide
  5' Phos
gggaatagtaagcgatagtaagcg

SEQ ID NO: 2039 - DNA, 24 bp, Artificial Sequence
  Description of Artificial Sequence: Synthetic oligonucleotide
  5' Phos
gggaacgctaagcgacgctaagcg

SEQ ID NO: 2040 - DNA, 24 bp, Artificial Sequence
  Description of Artificial Sequence: Synthetic oligonucleotide
  5' Phos
gggacttaagtccgcttaagtccg

SEQ ID NO: 2041 - DNA, 24 bp, Artificial Sequence
  Description of Artificial Sequence: Synthetic oligonucleotide
  5' Phos
gggattgttcgccgttgttcgccg

SEQ ID NO: 2042 - DNA, 24 bp, Artificial Sequence
  Description of Artificial Sequence: Synthetic oligonucleotide
  5' Phos
gggattccaagccgttccaagccg

SEQ ID NO: 2043 - DNA, 24 bp, Artificial Sequence
  Description of Artificial Sequence: Synthetic oligonucleotide
  5' Phos
gggaagcactaccgagcactaccg

SEQ ID NO: 2044 - DNA, 24 bp, Artificial Sequence
  Description of Artificial Sequence: Synthetic oligonucleotide
  5' Phos
gggatgtgtaaccgtgtgtaaccg

SEQ ID NO: 2045 - DNA, 24 bp, Artificial Sequence
  Description of Artificial Sequence: Synthetic oligonucleotide
  5' Phos
gggaacacggtacgacacggtacg

SEQ ID NO: 2046 - DNA, 24 bp, Artificial Sequence
  Description of Artificial Sequence: Synthetic oligonucleotide
  5' Phos
gggatggctctacgtggctctacg

SEQ ID NO: 2047 - DNA, 24 bp, Artificial Sequence
  Description of Artificial Sequence: Synthetic oligonucleotide
  5' Phos
gggacagtcctacgcagtcctacg

SEQ ID NO: 2048 - DNA, 24 bp, Artificial Sequence
  Description of Artificial Sequence: Synthetic oligonucleotide
  5' Phos
gggattgtgatacgttgtgatacg

SEQ ID NO: 2049 - DNA, 24 bp, Artificial Sequence
  Description of Artificial Sequence: Synthetic oligonucleotide
  5' Phos
gggatcgcaacacgtcgcaacacg

SEQ ID NO: 2050 - DNA, 24 bp, Artificial Sequence
  Description of Artificial Sequence: Synthetic oligonucleotide
  5' Phos
gggatggaccaacgtggaccaacg

SEQ ID NO: 2051 - DNA, 24 bp, Artificial Sequence
  Description of Artificial Sequence: Synthetic oligonucleotide
  5' Phos
gggatcggctgtagtcggctgtag

SEQ ID NO: 2052 - DNA, 24 bp, Artificial Sequence
  Description of Artificial Sequence: Synthetic oligonucleotide
  5' Phos
gggaccttgcgtagccttgcgtag

SEQ ID NO: 2053 - DNA, 24 bp, Artificial Sequence
  Description of Artificial Sequence: Synthetic oligonucleotide
  5' Phos
gggacacaccgtagcacaccgtag

SEQ ID NO: 2054 - DNA, 24 bp, Artificial Sequence
  Description of Artificial Sequence: Synthetic oligonucleotide
  5' Phos
gggaaggaacgtagaggaacgtag

SEQ ID NO: 2055 - DNA, 24 bp, Artificial Sequence
  Description of Artificial Sequence: Synthetic oligonucleotide
  5' Phos
gggactgcctctagctgcctctag

SEQ ID NO: 2056 - DNA, 24 bp, Artificial Sequence
  Description of Artificial Sequence: Synthetic oligonucleotide
  5' Phos
gggactggacctagctggacctag

SEQ ID NO: 2057 - DNA, 24 bp, Artificial Sequence
  Description of Artificial Sequence: Synthetic oligonucleotide
  5' Phos
gggaagcgacctagagcgacctag

SEQ ID NO: 2058 - DNA, 24 bp, Artificial Sequence
  Description of Artificial Sequence: Synthetic oligonucleotide
  5' Phos
gggaacggcgatagacggcgatag

SEQ ID NO: 2059 - DNA, 24 bp, Artificial Sequence
  Description of Artificial Sequence: Synthetic oligonucleotide
  5' Phos
gggaagatccatagagatccatag

SEQ ID NO: 2060 - DNA, 24 bp, Artificial Sequence
  Description of Artificial Sequence: Synthetic oligonucleotide
  5' Phos
gggaaactcgcgagaactcgcgag

SEQ ID NO: 2061 - DNA, 24 bp, Artificial Sequence
  Description of Artificial Sequence: Synthetic oligonucleotide
  5' Phos
gggattgccacgagttgccacgag

SEQ ID NO: 2062 - DNA, 24 bp, Artificial Sequence
  Description of Artificial Sequence: Synthetic oligonucleotide
  5' Phos
gggaagttgtagagagttgtagag

SEQ ID NO: 2063 - DNA, 24 bp, Artificial Sequence
  Description of Artificial Sequence: Synthetic oligonucleotide
  5' Phos
gggacgatatagagcgatatagag

SEQ ID NO: 2064 - DNA, 24 bp, Artificial Sequence
  Description of Artificial Sequence: Synthetic oligonucleotide
  5' Phos
gggatgaaggagagtgaaggagag

SEQ ID NO: 2065 - DNA, 24 bp, Artificial Sequence
  Description of Artificial Sequence: Synthetic oligonucleotide
  5' Phos
gggacgcaagagagcgcaagagag

SEQ ID NO: 2066 - DNA, 24 bp, Artificial Sequence
  Description of Artificial Sequence: Synthetic oligonucleotide
  5' Phos
gggacaacgcagagcaacgcagag

SEQ ID NO: 2067 - DNA, 24 bp, Artificial Sequence
  Description of Artificial Sequence: Synthetic oligonucleotide
  5' Phos
gggactggattcagctggattcag

SEQ ID NO: 2068 - DNA, 24 bp, Artificial Sequence
  Description of Artificial Sequence: Synthetic oligonucleotide
  5' Phos
gggaccaagctcagccaagctcag

SEQ ID NO: 2069 - DNA, 24 bp, Artificial Sequence
  Description of Artificial Sequence: Synthetic oligonucleotide
  5' Phos
gggatcggatccagtcggatccag

SEQ ID NO: 2070 - DNA, 24 bp, Artificial Sequence
  Description of Artificial Sequence: Synthetic oligonucleotide
  5' Phos
gggaatcagaccagatcagaccag

SEQ ID NO: 2071 - DNA, 24 bp, Artificial Sequence
  Description of Artificial Sequence: Synthetic oligonucleotide
  5' Phos
gggactgtggacagctgtggacag

SEQ ID NO: 2072 - DNA, 24 bp, Artificial Sequence
  Description of Artificial Sequence: Synthetic oligonucleotide
  5' Phos
gggaaggaggacagaggaggacag

SEQ ID NO: 2073 - DNA, 24 bp, Artificial Sequence
  Description of Artificial Sequence: Synthetic oligonucleotide
  5' Phos
gggacatccgacagcatccgacag

SEQ ID NO: 2074 - DNA, 24 bp, Artificial Sequence
  Description of Artificial Sequence: Synthetic oligonucleotide
  5' Phos
gggatcagatgaagtcagatgaag

SEQ ID NO: 2075 - DNA, 24 bp, Artificial Sequence
  Description of Artificial Sequence: Synthetic oligonucleotide
  5' Phos
gggaacgcaggaagacgcaggaag

SEQ ID NO: 2076 - DNA, 24 bp, Artificial Sequence
  Description of Artificial Sequence: Synthetic oligonucleotide
  5' Phos
gggactagccgaagctagccgaag

SEQ ID NO: 2077 - DNA, 24 bp, Artificial Sequence
  Description of Artificial Sequence: Synthetic oligonucleotide
  5' Phos
gggaccataagaagccataagaag

SEQ ID NO: 2078 - DNA, 24 bp, Artificial Sequence
  Description of Artificial Sequence: Synthetic oligonucleotide
  5' Phos
gggaatccaagaagatccaagaag

SEQ ID NO: 2079 - DNA, 24 bp, Artificial Sequence
  Description of Artificial Sequence: Synthetic oligonucleotide
  5' Phos
gggaccatcgcaagccatcgcaag

SEQ ID NO: 2080 - DNA, 24 bp, Artificial Sequence
  Description of Artificial Sequence: Synthetic oligonucleotide
  5' Phos
gggagctgaggttcgctgaggttc

SEQ ID NO: 2081 - DNA, 24 bp, Artificial Sequence
  Description of Artificial Sequence: Synthetic oligonucleotide
  5' Phos
gggataatccgttctaatccgttc

SEQ ID NO: 2082 - DNA, 24 bp, Artificial Sequence
  Description of Artificial Sequence: Synthetic oligonucleotide
  5' Phos
gggaaatgacgttcaatgacgttc

SEQ ID NO: 2083 - DNA, 24 bp, Artificial Sequence
  Description of Artificial Sequence: Synthetic oligonucleotide
  5' Phos
gggaggatcagttcggatcagttc

SEQ ID NO: 2084 - DNA, 24 bp, Artificial Sequence
  Description of Artificial Sequence: Synthetic oligonucleotide
  5' Phos
gggagactgctgtcgactgctgtc

SEQ ID NO: 2085 - DNA, 24 bp, Artificial Sequence
  Description of Artificial Sequence: Synthetic oligonucleotide
  5' Phos
gggaacattcggtcacattcggtc

SEQ ID NO: 2086 - DNA, 24 bp, Artificial Sequence
  Description of Artificial Sequence: Synthetic oligonucleotide
  5' Phos
gggatgatggcgtctgatggcgtc

SEQ ID NO: 2087 - DNA, 24 bp, Artificial Sequence
  Description of Artificial Sequence: Synthetic oligonucleotide
  5' Phos
gggagtatcgcgtcgtatcgcgtc

SEQ ID NO: 2088 - DNA, 24 bp, Artificial Sequence
  Description of Artificial Sequence: Synthetic oligonucleotide
  5' Phos
gggatcacagcgtctcacagcgtc

SEQ ID NO: 2089 - DNA, 24 bp, Artificial Sequence
  Description of Artificial Sequence: Synthetic oligonucleotide
  5' Phos
gggaaaggtccgtcaaggtccgtc

SEQ ID NO: 2090 - DNA, 24 bp, Artificial Sequence
  Description of Artificial Sequence: Synthetic oligonucleotide
  5' Phos
gggaagactccgtcagactccgtc

SEQ ID NO: 2091 - DNA, 24 bp, Artificial Sequence
  Description of Artificial Sequence: Synthetic oligonucleotide
  5' Phos
gggaggttgtgctcggttgtgctc

SEQ ID NO: 2092 - DNA, 24 bp, Artificial Sequence
  Description of Artificial Sequence: Synthetic oligonucleotide
  5' Phos
gggaggtcttcctcggtcttcctc

SEQ ID NO: 2093 - DNA, 24 bp, Artificial Sequence
  Description of Artificial Sequence: Synthetic oligonucleotide
  5' Phos
gggaatcgtgcctcatcgtgcctc

SEQ ID NO: 2094 - DNA, 24 bp, Artificial Sequence
  Description of Artificial Sequence: Synthetic oligonucleotide
  5' Phos
gggagcttcacctcgcttcacctc

SEQ ID NO: 2095 - DNA, 24 bp, Artificial Sequence
  Description of Artificial Sequence: Synthetic oligonucleotide
  5' Phos
gggaggtgtgactcggtgtgactc

SEQ ID NO: 2096 - DNA, 24 bp, Artificial Sequence
  Description of Artificial Sequence: Synthetic oligonucleotide
  5' Phos
gggagtctggactcgtctggactc

SEQ ID NO: 2097 - DNA, 24 bp, Artificial Sequence
  Description of Artificial Sequence: Synthetic oligonucleotide
  5' Phos
gggaacaggttatcacaggttatc

SEQ ID NO: 2098 - DNA, 24 bp, Artificial Sequence
  Description of Artificial Sequence: Synthetic oligonucleotide
  5' Phos
gggagccttggatcgccttggatc

SEQ ID NO: 2099 - DNA, 24 bp, Artificial Sequence
  Description of Artificial Sequence: Synthetic oligonucleotide
  5' Phos
gggatggctcgatctggctcgatc

SEQ ID NO: 2100 - DNA, 24 bp, Artificial Sequence
  Description of Artificial Sequence: Synthetic oligonucleotide
  5' Phos
gggagattgccatcgattgccatc

SEQ ID NO: 2101 - DNA, 24 bp, Artificial Sequence
  Description of Artificial Sequence: Synthetic oligonucleotide
  5' Phos
gggagttggtaatcgttggtaatc

SEQ ID NO: 2102 - DNA, 24 bp, Artificial Sequence
  Description of Artificial Sequence: Synthetic oligonucleotide
  5' Phos
gggaaagacgaatcaagacgaatc

SEQ ID NO: 2103 - DNA, 24 bp, Artificial Sequence
  Description of Artificial Sequence: Synthetic oligonucleotide
  5' Phos
gggatccaacaatctccaacaatc

SEQ ID NO: 2104 - DNA, 24 bp, Artificial Sequence
  Description of Artificial Sequence: Synthetic oligonucleotide
  5' Phos
gggatccgtgttgctccgtgttgc

SEQ ID NO: 2105 - DNA, 24 bp, Artificial Sequence
  Description of Artificial Sequence: Synthetic oligonucleotide
  5' Phos
gggagtaccattgcgtaccattgc

SEQ ID NO: 2106 - DNA, 24 bp, Artificial Sequence
  Description of Artificial Sequence: Synthetic oligonucleotide
  5' Phos
gggaaatgtggtgcaatgtggtgc

SEQ ID NO: 2107 - DNA, 24 bp, Artificial Sequence
  Description of Artificial Sequence: Synthetic oligonucleotide
  5' Phos
gggagccaatctgcgccaatctgc

SEQ ID NO: 2108 - DNA, 24 bp, Artificial Sequence
  Description of Artificial Sequence: Synthetic oligonucleotide
  5' Phos
gggagctatcctgcgctatcctgc

SEQ ID NO: 2109 - DNA, 24 bp, Artificial Sequence
  Description of Artificial Sequence: Synthetic oligonucleotide
  5' Phos
gggaggattaatgcggattaatgc

SEQ ID NO: 2110 - DNA, 24 bp, Artificial Sequence
  Description of Artificial Sequence: Synthetic oligonucleotide
  5' Phos
gggaagatggtggcagatggtggc

SEQ ID NO: 2111 - DNA, 24 bp, Artificial Sequence
  Description of Artificial Sequence: Synthetic oligonucleotide
  5' Phos
gggaggtatctggcggtatctggc

SEQ ID NO: 2112 - DNA, 24 bp, Artificial Sequence
  Description of Artificial Sequence: Synthetic oligonucleotide
  5' Phos
gggatatctatggctatctatggc

SEQ ID NO: 2113 - DNA, 24 bp, Artificial Sequence
  Description of Artificial Sequence: Synthetic oligonucleotide
  5' Phos
gttggtccaatggcgtccaatggc

SEQ ID NO: 2114 - DNA, 24 bp, Artificial Sequence
  Description of Artificial Sequence: Synthetic oligonucleotide
  5' Phos
gttgaggattcggcaggattcggc

SEQ ID NO: 2115 - DNA, 24 bp, Artificial Sequence
  Description of Artificial Sequence: Synthetic oligonucleotide
  5' Phos
gttgtagacacggctagacacggc

SEQ ID NO: 2116 - DNA, 24 bp, Artificial Sequence
  Description of Artificial Sequence: Synthetic oligonucleotide
  5' Phos
gttggagataaggcgagataaggc

SEQ ID NO: 2117 - DNA, 24 bp, Artificial Sequence
  Description of Artificial Sequence: Synthetic oligonucleotide
  5' Phos
gttgaagcgaaggcaagcgaaggc

SEQ ID NO: 2118 - DNA, 24 bp, Artificial Sequence
  Description of Artificial Sequence: Synthetic oligonucleotide
  5' Phos
gttgaccacttcgcaccacttcgc

SEQ ID NO: 2119 - DNA, 24 bp, Artificial Sequence
  Description of Artificial Sequence: Synthetic oligonucleotide
  5' Phos
gttgagatattcgcagatattcgc

SEQ ID NO: 2120 - DNA, 24 bp, Artificial Sequence
  Description of Artificial Sequence: Synthetic oligonucleotide
  5' Phos
gttggtatcagcgcgtatcagcgc

SEQ ID NO: 2121 - DNA, 24 bp, Artificial Sequence
  Description of Artificial Sequence: Synthetic oligonucleotide
  5' Phos
gttgagaagtccgcagaagtccgc

SEQ ID NO: 2122 - DNA, 24 bp, Artificial Sequence
  Description of Artificial Sequence: Synthetic oligonucleotide
  5' Phos
gttgacttatccgcacttatccgc

SEQ ID NO: 2123 - DNA, 24 bp, Artificial Sequence
  Description of Artificial Sequence: Synthetic oligonucleotide
  5' Phos
gttgaatggaccgcaatggaccgc

SEQ ID NO: 2124 - DNA, 24 bp, Artificial Sequence
  Description of Artificial Sequence: Synthetic oligonucleotide
  5' Phos
gttgttaactgagcttaactgagc

SEQ ID NO: 2125 - DNA, 24 bp, Artificial Sequence
  Description of Artificial Sequence: Synthetic oligonucleotide
  5' Phos
gttgtagaatgagctagaatgagc

SEQ ID NO: 2126 - DNA, 24 bp, Artificial Sequence
  Description of Artificial Sequence: Synthetic oligonucleotide
  5' Phos
gttggcttaggagcgcttaggagc

SEQ ID NO: 2127 - DNA, 24 bp, Artificial Sequence
  Description of Artificial Sequence: Synthetic oligonucleotide
  5' Phos
gttgtccttccagctccttccagc

SEQ ID NO: 2128 - DNA, 24 bp, Artificial Sequence
  Description of Artificial Sequence: Synthetic oligonucleotide
  5' Phos
gttgacattgttccacattgttcc

SEQ ID NO: 2129 - DNA, 24 bp, Artificial Sequence
  Description of Artificial Sequence: Synthetic oligonucleotide
  5' Phos
gttggagatgttccgagatgttcc

SEQ ID NO: 2130 - DNA, 24 bp, Artificial Sequence
  Description of Artificial Sequence: Synthetic oligonucleotide
  5' Phos
gttgtactggttcctactggttcc

SEQ ID NO: 2131 - DNA, 24 bp, Artificial Sequence
  Description of Artificial Sequence: Synthetic oligonucleotide
  5' Phos
gttgaagtcgttccaagtcgttcc

SEQ ID NO: 2132 - DNA, 24 bp, Artificial Sequence
  Description of Artificial Sequence: Synthetic oligonucleotide
  5' Phos
gttgatcatcttccatcatcttcc

SEQ ID NO: 2133 - DNA, 24 bp, Artificial Sequence
  Description of Artificial Sequence: Synthetic oligonucleotide
  5' Phos
gttggtctccttccgtctccttcc

SEQ ID NO: 2134 - DNA, 24 bp, Artificial Sequence
  Description of Artificial Sequence: Synthetic oligonucleotide
  5' Phos
gttgtaccacttcctaccacttcc

SEQ ID NO: 2135 - DNA, 24 bp, Artificial Sequence
  Description of Artificial Sequence: Synthetic oligonucleotide
  5' Phos
gttgacctgattccacctgattcc

SEQ ID NO: 2136 - DNA, 24 bp, Artificial Sequence
  Description of Artificial Sequence: Synthetic oligonucleotide
  5' Phos
gttgtacacattcctacacattcc

SEQ ID NO: 2137 - DNA, 24 bp, Artificial Sequence
  Description of Artificial Sequence: Synthetic oligonucleotide
  5' Phos
gttgtcctatctcctcctatctcc

SEQ ID NO: 2138 - DNA, 24 bp, Artificial Sequence
  Description of Artificial Sequence: Synthetic oligonucleotide
  5' Phos
gttgggattgctccggattgctcc

SEQ ID NO: 2139 - DNA, 24 bp, Artificial Sequence
  Description of Artificial Sequence: Synthetic oligonucleotide
  5' Phos
gttggatgtcctccgatgtcctcc

SEQ ID NO: 2140 - DNA, 24 bp, Artificial Sequence
  Description of Artificial Sequence: Synthetic oligonucleotide
  5' Phos
gttgggctattgccggctattgcc

SEQ ID NO: 2141 - DNA, 24 bp, Artificial Sequence
  Description of Artificial Sequence: Synthetic oligonucleotide
  5' Phos
gttgtccttctgcctccttctgcc

SEQ ID NO: 2142 - DNA, 24 bp, Artificial Sequence
  Description of Artificial Sequence: Synthetic oligonucleotide
  5' Phos
gttgtattcctgcctattcctgcc

SEQ ID NO: 2143 - DNA, 24 bp, Artificial Sequence
  Description of Artificial Sequence: Synthetic oligonucleotide
  5' Phos
gttgggtgtatgccggtgtatgcc

SEQ ID NO: 2144 - DNA, 24 bp, Artificial Sequence
  Description of Artificial Sequence: Synthetic oligonucleotide
  5' Phos
gttgtacaacggcctacaacggcc

SEQ ID NO: 2145 - DNA, 24 bp, Artificial Sequence
  Description of Artificial Sequence: Synthetic oligonucleotide
  5' Phos
gttgtaagcaggcctaagcaggcc

SEQ ID NO: 2146 - DNA, 24 bp, Artificial Sequence
  Description of Artificial Sequence: Synthetic oligonucleotide
  5' Phos
gttgttacctcgccttacctcgcc

SEQ ID NO: 2147 - DNA, 24 bp, Artificial Sequence
  Description of Artificial Sequence: Synthetic oligonucleotide
  5' Phos
gttgatgtcacgccatgtcacgcc

SEQ ID NO: 2148 - DNA, 24 bp, Artificial Sequence
  Description of Artificial Sequence: Synthetic oligonucleotide
  5' Phos
gttgtcttggagcctcttggagcc

SEQ ID NO: 2149 - DNA, 24 bp, Artificial Sequence
  Description of Artificial Sequence: Synthetic oligonucleotide
  5' Phos
gttgttgagcagccttgagcagcc

SEQ ID NO: 2150 - DNA, 24 bp, Artificial Sequence
  Description of Artificial Sequence: Synthetic oligonucleotide
  5' Phos
gttgaagcacagccaagcacagcc

SEQ ID NO: 2151 - DNA, 24 bp, Artificial Sequence
  Description of Artificial Sequence: Synthetic oligonucleotide
  5' Phos
gttggacagaagccgacagaagcc

SEQ ID NO: 2152 - DNA, 24 bp, Artificial Sequence
  Description of Artificial Sequence: Synthetic oligonucleotide
  5' Phos
gttgaagcgataccaagcgatacc

SEQ ID NO: 2153 - DNA, 24 bp, Artificial Sequence
  Description of Artificial Sequence: Synthetic oligonucleotide
  5' Phos
gttgtggaaggacctggaaggacc

SEQ ID NO: 2154 - DNA, 24 bp, Artificial Sequence
  Description of Artificial Sequence: Synthetic oligonucleotide
  5' Phos
gttgataaccgaccataaccgacc

SEQ ID NO: 2155 - DNA, 24 bp, Artificial Sequence
  Description of Artificial Sequence: Synthetic oligonucleotide
  5' Phos
gttgtcgtcagacctcgtcagacc

SEQ ID NO: 2156 - DNA, 24 bp, Artificial Sequence
  Description of Artificial Sequence: Synthetic oligonucleotide
  5' Phos
gttgagtggtcaccagtggtcacc

SEQ ID NO: 2157 - DNA, 24 bp, Artificial Sequence
  Description of Artificial Sequence: Synthetic oligonucleotide
  5' Phos
gttgtggactcacctggactcacc

SEQ ID NO: 2158 - DNA, 24 bp, Artificial Sequence
  Description of Artificial Sequence: Synthetic oligonucleotide
  5' Phos
gttgattcgccaccattcgccacc

SEQ ID NO: 2159 - DNA, 24 bp, Artificial Sequence
  Description of Artificial Sequence: Synthetic oligonucleotide
  5' Phos
gttggatatacaccgatatacacc

SEQ ID NO: 2160 - DNA, 24 bp, Artificial Sequence
  Description of Artificial Sequence: Synthetic oligonucleotide
  5' Phos
gttgttaaggaaccttaaggaacc

SEQ ID NO: 2161 - DNA, 24 bp, Artificial Sequence
  Description of Artificial Sequence: Synthetic oligonucleotide
  5' Phos
gttgttgtagaaccttgtagaacc

SEQ ID NO: 2162 - DNA, 24 bp, Artificial Sequence
  Description of Artificial Sequence: Synthetic oligonucleotide
  5' Phos
gttgaacgccaaccaacgccaacc

SEQ ID NO: 2163 - DNA, 24 bp, Artificial Sequence
  Description of Artificial Sequence: Synthetic oligonucleotide
  5' Phos
gttgagcgtgttacagcgtgttac

SEQ ID NO: 2164 - DNA, 24 bp, Artificial Sequence
  Description of Artificial Sequence: Synthetic oligonucleotide
  5' Phos
gttggtcgctctacgtcgctctac

SEQ ID NO: 2165 - DNA, 24 bp, Artificial Sequence
  Description of Artificial Sequence: Synthetic oligonucleotide
  5' Phos
gttggagcagctacgagcagctac

SEQ ID NO: 2166 - DNA, 24 bp, Artificial Sequence
  Description of Artificial Sequence: Synthetic oligonucleotide
  5' Phos
gttgatccacctacatccacctac

SEQ ID NO: 2167 - DNA, 24 bp, Artificial Sequence
  Description of Artificial Sequence: Synthetic oligonucleotide
  5' Phos
gttgggctgactacggctgactac

SEQ ID NO: 2168 - DNA, 24 bp, Artificial Sequence
  Description of Artificial Sequence: Synthetic oligonucleotide
  5' Phos
gttggtggaaggacgtggaaggac

SEQ ID NO: 2169 - DNA, 24 bp, Artificial Sequence
  Description of Artificial Sequence: Synthetic oligonucleotide
  5' Phos
gttgactgctcgacactgctcgac

SEQ ID NO: 2170 - DNA, 24 bp, Artificial Sequence
  Description of Artificial Sequence: Synthetic oligonucleotide
  5' Phos
gttgtctgtgcgactctgtgcgac

SEQ ID NO: 2171 - DNA, 24 bp, Artificial Sequence
  Description of Artificial Sequence: Synthetic oligonucleotide
  5' Phos
gttggaagtgcgacgaagtgcgac

SEQ ID NO: 2172 - DNA, 24 bp, Artificial Sequence
  Description of Artificial Sequence: Synthetic oligonucleotide
  5' Phos
gttgaccaccagacaccaccagac

SEQ ID NO: 2173 - DNA, 24 bp, Artificial Sequence
  Description of Artificial Sequence: Synthetic oligonucleotide
  5' Phos
gttgaacagttcacaacagttcac

SEQ ID NO: 2174 - DNA, 24 bp, Artificial Sequence
  Description of Artificial Sequence: Synthetic oligonucleotide
  5' Phos
gttgaggatggcacaggatggcac

SEQ ID NO: 2175 - DNA, 24 bp, Artificial Sequence
  Description of Artificial Sequence: Synthetic oligonucleotide
  5' Phos
gttggttcacgcacgttcacgcac

SEQ ID NO: 2176 - DNA, 24 bp, Artificial Sequence
  Description of Artificial Sequence: Synthetic oligonucleotide
  5' Phos
gttgacatctccacacatctccac

SEQ ID NO: 2177 - DNA, 24 bp, Artificial Sequence
  Description of Artificial Sequence: Synthetic oligonucleotide
  5' Phos
gttggttgcaccacgttgcaccac

SEQ ID NO: 2178 - DNA, 24 bp, Artificial Sequence
  Description of Artificial Sequence: Synthetic oligonucleotide
  5' Phos
gttgttaacgacacttaacgacac

SEQ ID NO: 2179 - DNA, 24 bp, Artificial Sequence
  Description of Artificial Sequence: Synthetic oligonucleotide
  5' Phos
gttgattgagacacattgagacac

SEQ ID NO: 2180 - DNA, 24 bp, Artificial Sequence
  Description of Artificial Sequence: Synthetic oligonucleotide
  5' Phos
gttggtcatcacacgtcatcacac

SEQ ID NO: 2181 - DNA, 24 bp, Artificial Sequence
  Description of Artificial Sequence: Synthetic oligonucleotide
  5' Phos
gttggcgatctaacgcgatctaac

SEQ ID NO: 2182 - DNA, 24 bp, Artificial Sequence
  Description of Artificial Sequence: Synthetic oligonucleotide
  5' Phos
gttgtatcggcttatatcggctta

SEQ ID NO: 2183 - DNA, 24 bp, Artificial Sequence
  Description of Artificial Sequence: Synthetic oligonucleotide
  5' Phos
gttgggtgtccttaggtgtcctta

SEQ ID NO: 2184 - DNA, 24 bp, Artificial Sequence
  Description of Artificial Sequence: Synthetic oligonucleotide
  5' Phos
gttgcttggccttacttggcctta

SEQ ID NO: 2185 - DNA, 24 bp, Artificial Sequence
  Description of Artificial Sequence: Synthetic oligonucleotide
  5' Phos
gttgctcgctattactcgctatta

SEQ ID NO: 2186 - DNA, 24 bp, Artificial Sequence
  Description of Artificial Sequence: Synthetic oligonucleotide
  5' Phos
gttgccggccattaccggccatta

SEQ ID NO: 2187 - DNA, 24 bp, Artificial Sequence
  Description of Artificial Sequence: Synthetic oligonucleotide
  5' Phos
gttgtccaatggtatccaatggta

SEQ ID NO: 2188 - DNA, 24 bp, Artificial Sequence
  Description of Artificial Sequence: Synthetic oligonucleotide
  5' Phos
gttgggtggtcgtaggtggtcgta

SEQ ID NO: 2189 - DNA, 24 bp, Artificial Sequence
  Description of Artificial Sequence: Synthetic oligonucleotide
  5' Phos
gttgtaaggtcgtataaggtcgta

SEQ ID NO: 2190 - DNA, 24 bp, Artificial Sequence
  Description of Artificial Sequence: Synthetic oligonucleotide
  5' Phos
gttggaatcacgtagaatcacgta

SEQ ID NO: 2191 - DNA, 24 bp, Artificial Sequence
  Description of Artificial Sequence: Synthetic oligonucleotide
  5' Phos
gttgctgactagtactgactagta

SEQ ID NO: 2192 - DNA, 24 bp, Artificial Sequence
  Description of Artificial Sequence: Synthetic oligonucleotide
  5' Phos
gttgcttgtcagtacttgtcagta

SEQ ID NO: 2193 - DNA, 24 bp, Artificial Sequence
  Description of Artificial Sequence: Synthetic oligonucleotide
  5' Phos
gttggccagcagtagccagcagta

SEQ ID NO: 2194 - DNA, 24 bp, Artificial Sequence
  Description of Artificial Sequence: Synthetic oligonucleotide
  5' Phos
gttgttacggtctattacggtcta

SEQ ID NO: 2195 - DNA, 24 bp, Artificial Sequence
  Description of Artificial Sequence: Synthetic oligonucleotide
  5' Phos
gttgtcttcgtctatcttcgtcta

SEQ ID NO: 2196 - DNA, 24 bp, Artificial Sequence
  Description of Artificial Sequence: Synthetic oligonucleotide
  5' Phos
gttgggctaggctaggctaggcta

SEQ ID NO: 2197 - DNA, 24 bp, Artificial Sequence
  Description of Artificial Sequence: Synthetic oligonucleotide
  5' Phos
gttggaattcgctagaattcgcta

SEQ ID NO: 2198 - DNA, 24 bp, Artificial Sequence
  Description of Artificial Sequence: Synthetic oligonucleotide
  5' Phos
gttggtggcagctagtggcagcta

SEQ ID NO: 2199 - DNA, 24 bp, Artificial Sequence
  Description of Artificial Sequence: Synthetic oligonucleotide
  5' Phos
gttgtgcctacctatgcctaccta

SEQ ID NO: 2200 - DNA, 24 bp, Artificial Sequence
  Description of Artificial Sequence: Synthetic oligonucleotide
  5' Phos
gttggtaacgactagtaacgacta

SEQ ID NO: 2201 - DNA, 24 bp, Artificial Sequence
  Description of Artificial Sequence: Synthetic oligonucleotide
  5' Phos
gttgcttcgcactacttcgcacta

SEQ ID NO: 2202 - DNA, 24 bp, Artificial Sequence
  Description of Artificial Sequence: Synthetic oligonucleotide
  5' Phos
gttggcgtccactagcgtccacta

SEQ ID NO: 2203 - DNA, 24 bp, Artificial Sequence
  Description of Artificial Sequence: Synthetic oligonucleotide
  5' Phos
gttgcaccgttatacaccgttata

SEQ ID NO: 2204 - DNA, 24 bp, Artificial Sequence
  Description of Artificial Sequence: Synthetic oligonucleotide
  5' Phos
gttgcggttctatacggttctata

SEQ ID NO: 2205 - DNA, 24 bp, Artificial Sequence
  Description of Artificial Sequence: Synthetic oligonucleotide
  5' Phos
gttgccttcggataccttcggata

SEQ ID NO: 2206 - DNA, 24 bp, Artificial Sequence
  Description of Artificial Sequence: Synthetic oligonucleotide
  5' Phos
gttgggctccgataggctccgata

SEQ ID NO: 2207 - DNA, 24 bp, Artificial Sequence
  Description of Artificial Sequence: Synthetic oligonucleotide
  5' Phos
gttgcaggccgatacaggccgata

SEQ ID NO: 2208 - DNA, 24 bp, Artificial Sequence
  Description of Artificial Sequence: Synthetic oligonucleotide
  5' Phos
gttggccgacgatagccgacgata

SEQ ID NO: 2209 - DNA, 24 bp, Artificial Sequence
  Description of Artificial Sequence: Synthetic oligonucleotide
  5' Phos
gttggtggcgcatagtggcgcata

SEQ ID NO: 2210 - DNA, 24 bp, Artificial Sequence
  Description of Artificial Sequence: Synthetic oligonucleotide
  5' Phos
gttggacggccatagacggccata

SEQ ID NO: 2211 - DNA, 24 bp, Artificial Sequence
  Description of Artificial Sequence: Synthetic oligonucleotide
  5' Phos
gttgcggaagaatacggaagaata

SEQ ID NO: 2212 - DNA, 24 bp, Artificial Sequence
  Description of Artificial Sequence: Synthetic oligonucleotide
  5' Phos
gttgcgttgcttgacgttgcttga

SEQ ID NO: 2213 - DNA, 24 bp, Artificial Sequence
  Description of Artificial Sequence: Synthetic oligonucleotide
  5' Phos
gttggactgcttgagactgcttga

SEQ ID NO: 2214 - DNA, 24 bp, Artificial Sequence
  Description of Artificial Sequence: Synthetic oligonucleotide
  5' Phos
gttgtcggacttgatcggacttga

SEQ ID NO: 2215 - DNA, 24 bp, Artificial Sequence
  Description of Artificial Sequence: Synthetic oligonucleotide
  5' Phos
gttgtctcgattgatctcgattga

SEQ ID NO: 2216 - DNA, 24 bp, Artificial Sequence
  Description of Artificial Sequence: Synthetic oligonucleotide
  5' Phos
gttgtcgacattgatcgacattga

SEQ ID NO: 2217 - DNA, 24 bp, Artificial Sequence
  Description of Artificial Sequence: Synthetic oligonucleotide
  5' Phos
gttggcctcagtgagcctcagtga

SEQ ID NO: 2218 - DNA, 24 bp, Artificial Sequence
  Description of Artificial Sequence: Synthetic oligonucleotide
  5' Phos
gttggtctcgctgagtctcgctga

SEQ ID NO: 2219 - DNA, 24 bp, Artificial Sequence
  Description of Artificial Sequence: Synthetic oligonucleotide
  5' Phos
gttgttcctcctgattcctcctga

SEQ ID NO: 2220 - DNA, 24 bp, Artificial Sequence
  Description of Artificial Sequence: Synthetic oligonucleotide
  5' Phos
gttgctgtgcctgactgtgcctga

SEQ ID NO: 2221 - DNA, 24 bp, Artificial Sequence
  Description of Artificial Sequence: Synthetic oligonucleotide
  5' Phos
gttgggaagcctgaggaagcctga

SEQ ID NO: 2222 - DNA, 24 bp, Artificial Sequence
  Description of Artificial Sequence: Synthetic oligonucleotide
  5' Phos
gttgcgagtgtggacgagtgtgga

SEQ ID NO: 2223 - DNA, 24 bp, Artificial Sequence
  Description of Artificial Sequence: Synthetic oligonucleotide
  5' Phos
gttgtcgctgtggatcgctgtgga

SEQ ID NO: 2224 - DNA, 24 bp, Artificial Sequence
  Description of Artificial Sequence: Synthetic oligonucleotide
  5' Phos
gttgtgcagctggatgcagctgga

SEQ ID NO: 2225 - DNA, 24 bp, Artificial Sequence
  Description of Artificial Sequence: Synthetic oligonucleotide
  5' Phos
gttgggattatggaggattatgga

SEQ ID NO: 2226 - DNA, 24 bp, Artificial Sequence
  Description of Artificial Sequence: Synthetic oligonucleotide
  5' Phos
gttgttggtccggattggtccgga

SEQ ID NO: 2227 - DNA, 24 bp, Artificial Sequence
  Description of Artificial Sequence: Synthetic oligonucleotide
  5' Phos
gttgccgttacggaccgttacgga

SEQ ID NO: 2228 - DNA, 24 bp, Artificial Sequence
  Description of Artificial Sequence: Synthetic oligonucleotide
  5' Phos
gttggacctacggagacctacgga

SEQ ID NO: 2229 - DNA, 24 bp, Artificial Sequence
  Description of Artificial Sequence: Synthetic oligonucleotide
  5' Phos
gttgcttggacggacttggacgga

SEQ ID NO: 2230 - DNA, 24 bp, Artificial Sequence
  Description of Artificial Sequence: Synthetic oligonucleotide
  5' Phos
gttgcggttcaggacggttcagga

SEQ ID NO: 2231 - DNA, 24 bp, Artificial Sequence
  Description of Artificial Sequence: Synthetic oligonucleotide
  5' Phos
gttgcatgccaggacatgccagga

SEQ ID NO: 2232 - DNA, 24 bp, Artificial Sequence
  Description of Artificial Sequence: Synthetic oligonucleotide
  5' Phos
gttgtgtagcgcgatgtagcgcga

SEQ ID NO: 2233 - DNA, 24 bp, Artificial Sequence
  Description of Artificial Sequence: Synthetic oligonucleotide
  5' Phos
gttgtggtaaccgatggtaaccga

SEQ ID NO: 2234 - DNA, 24 bp, Artificial Sequence
  Description of Artificial Sequence: Synthetic oligonucleotide
  5' Phos
gttgtgacggacgatgacggacga

SEQ ID NO: 2235 - DNA, 24 bp, Artificial Sequence
  Description of Artificial Sequence: Synthetic oligonucleotide
  5' Phos
gttgctgaggacgactgaggacga

SEQ ID NO: 2236 - DNA, 24 bp, Artificial Sequence
  Description of Artificial Sequence: Synthetic oligonucleotide
  5' Phos
gttggagcggtagagagcggtaga

SEQ ID NO: 2237 - DNA, 24 bp, Artificial Sequence
  Description of Artificial Sequence: Synthetic oligonucleotide
  5' Phos
gttgccgagctagaccgagctaga

SEQ ID NO: 2238 - DNA, 24 bp, Artificial Sequence
  Description of Artificial Sequence: Synthetic oligonucleotide
  5' Phos
gttgtcagccgagatcagccgaga

SEQ ID NO: 2239 - DNA, 24 bp, Artificial Sequence
  Description of Artificial Sequence: Synthetic oligonucleotide
  5' Phos
gttgctgaccgagactgaccgaga

SEQ ID NO: 2240 - DNA, 24 bp, Artificial Sequence
  Description of Artificial Sequence: Synthetic oligonucleotide
  5' Phos
gttggatctagagagatctagaga

SEQ ID NO: 2241 - DNA, 24 bp, Artificial Sequence
  Description of Artificial Sequence: Synthetic oligonucleotide
  5' Phos
gttgtgcggtcagatgcggtcaga

SEQ ID NO: 2242 - DNA, 24 bp, Artificial Sequence
  Description of Artificial Sequence: Synthetic oligonucleotide
  5' Phos
gttgtctgtccagatctgtccaga

SEQ ID NO: 2243 - DNA, 24 bp, Artificial Sequence
  Description of Artificial Sequence: Synthetic oligonucleotide
  5' Phos
gttgcttatccagacttatccaga

SEQ ID NO: 2244 - DNA, 24 bp, Artificial Sequence
  Description of Artificial Sequence: Synthetic oligonucleotide
  5' Phos
gttgggccgtaagaggccgtaaga

SEQ ID NO: 2245 - DNA, 24 bp, Artificial Sequence
  Description of Artificial Sequence: Synthetic oligonucleotide
  5' Phos
gttggtatgcaagagtatgcaaga

SEQ ID NO: 2246 - DNA, 24 bp, Artificial Sequence
  Description of Artificial Sequence: Synthetic oligonucleotide
  5' Phos
gttgtccaagttcatccaagttca

SEQ ID NO: 2247 - DNA, 24 bp, Artificial Sequence
  Description of Artificial Sequence: Synthetic oligonucleotide
  5' Phos
gttgcgctgtgtcacgctgtgtca

SEQ ID NO: 2248 - DNA, 24 bp, Artificial Sequence
  Description of Artificial Sequence: Synthetic oligonucleotide
  5' Phos
gttgggacctgtcaggacctgtca

SEQ ID NO: 2249 - DNA, 24 bp, Artificial Sequence
  Description of Artificial Sequence: Synthetic oligonucleotide
  5' Phos
gttgcggaaggtcacggaaggtca

SEQ ID NO: 2250 - DNA, 24 bp, Artificial Sequence
  Description of Artificial Sequence: Synthetic oligonucleotide
  5' Phos
gttgtccgacgtcatccgacgtca

SEQ ID NO: 2251 - DNA, 24 bp, Artificial Sequence
  Description of Artificial Sequence: Synthetic oligonucleotide
  5' Phos
gttggagatagtcagagatagtca

SEQ ID NO: 2252 - DNA, 24 bp, Artificial Sequence
  Description of Artificial Sequence: Synthetic oligonucleotide
  5' Phos
gttgcctggagtcacctggagtca

SEQ ID NO: 2253 - DNA, 24 bp, Artificial Sequence
  Description of Artificial Sequence: Synthetic oligonucleotide
  5' Phos
gttgcctgctctcacctgctctca

SEQ ID NO: 2254 - DNA, 24 bp, Artificial Sequence
  Description of Artificial Sequence: Synthetic oligonucleotide
  5' Phos
gttgtggaggctcatggaggctca

SEQ ID NO: 2255 - DNA, 24 bp, Artificial Sequence
  Description of Artificial Sequence: Synthetic oligonucleotide
  5' Phos
gttgtccatactcatccatactca

SEQ ID NO: 2256 - DNA, 24 bp, Artificial Sequence
  Description of Artificial Sequence: Synthetic oligonucleotide
  5' Phos
gttggtatgttgcagtatgttgca

SEQ ID NO: 2257 - DNA, 24 bp, Artificial Sequence
  Description of Artificial Sequence: Synthetic oligonucleotide
  5' Phos
gttgctacagcgcactacagcgca

SEQ ID NO: 2258 - DNA, 24 bp, Artificial Sequence
  Description of Artificial Sequence: Synthetic oligonucleotide
  5' Phos
gttgccggttagcaccggttagca

SEQ ID NO: 2259 - DNA, 24 bp, Artificial Sequence
  Description of Artificial Sequence: Synthetic oligonucleotide
  5' Phos
gttgcagtggagcacagtggagca

SEQ ID NO: 2260 - DNA, 24 bp, Artificial Sequence
  Description of Artificial Sequence: Synthetic oligonucleotide
  5' Phos
gttggctccttccagctccttcca

SEQ ID NO: 2261 - DNA, 24 bp, Artificial Sequence
  Description of Artificial Sequence: Synthetic oligonucleotide
  5' Phos
gttggtcactgccagtcactgcca

SEQ ID NO: 2262 - DNA, 24 bp, Artificial Sequence
  Description of Artificial Sequence: Synthetic oligonucleotide
  5' Phos
gttggctgatgccagctgatgcca

SEQ ID NO: 2263 - DNA, 24 bp, Artificial Sequence
  Description of Artificial Sequence: Synthetic oligonucleotide
  5' Phos
gttgtataaggccatataaggcca

SEQ ID NO: 2264 - DNA, 24 bp, Artificial Sequence
  Description of Artificial Sequence: Synthetic oligonucleotide
  5' Phos
gttgtgcttcgccatgcttcgcca

SEQ ID NO: 2265 - DNA, 24 bp, Artificial Sequence
  Description of Artificial Sequence: Synthetic oligonucleotide
  5' Phos
gttgtcttaagccatcttaagcca

SEQ ID NO: 2266 - DNA, 24 bp, Artificial Sequence
  Description of Artificial Sequence: Synthetic oligonucleotide
  5' Phos
gttggagctgaccagagctgacca

SEQ ID NO: 2267 - DNA, 24 bp, Artificial Sequence
  Description of Artificial Sequence: Synthetic oligonucleotide
  5' Phos
gttggttggaaccagttggaacca

SEQ ID NO: 2268 - DNA, 24 bp, Artificial Sequence
  Description of Artificial Sequence: Synthetic oligonucleotide
  5' Phos
gttgttaccaaccattaccaacca

SEQ ID NO: 2269 - DNA, 24 bp, Artificial Sequence
  Description of Artificial Sequence: Synthetic oligonucleotide
  5' Phos
gttgtgcgcgtacatgcgcgtaca

SEQ ID NO: 2270 - DNA, 24 bp, Artificial Sequence
  Description of Artificial Sequence: Synthetic oligonucleotide
  5' Phos
gttgccagcgtacaccagcgtaca

SEQ ID NO: 2271 - DNA, 24 bp, Artificial Sequence
  Description of Artificial Sequence: Synthetic oligonucleotide
  5' Phos
gttgcaatgctacacaatgctaca

SEQ ID NO: 2272 - DNA, 24 bp, Artificial Sequence
  Description of Artificial Sequence: Synthetic oligonucleotide
  5' Phos
gttgcggcactacacggcactaca

SEQ ID NO: 2273 - DNA, 24 bp, Artificial Sequence
  Description of Artificial Sequence: Synthetic oligonucleotide
  5' Phos
gttgcagattcacacagattcaca

SEQ ID NO: 2274 - DNA, 24 bp, Artificial Sequence
  Description of Artificial Sequence: Synthetic oligonucleotide
  5' Phos
gttgccacggaacaccacggaaca

SEQ ID NO: 2275 - DNA, 24 bp, Artificial Sequence
  Description of Artificial Sequence: Synthetic oligonucleotide
  5' Phos
gttgcacgcgctaacacgcgctaa

SEQ ID NO: 2276 - DNA, 24 bp, Artificial Sequence
  Description of Artificial Sequence: Synthetic oligonucleotide
  5' Phos
gttggtccaactaagtccaactaa

SEQ ID NO: 2277 - DNA, 24 bp, Artificial Sequence
  Description of Artificial Sequence: Synthetic oligonucleotide
  5' Phos
gttggaagttggaagaagttggaa

SEQ ID NO: 2278 - DNA, 24 bp, Artificial Sequence
  Description of Artificial Sequence: Synthetic oligonucleotide
  5' Phos
gttgcctgacggaacctgacggaa

SEQ ID NO: 2279 - DNA, 24 bp, Artificial Sequence
  Description of Artificial Sequence: Synthetic oligonucleotide
  5' Phos
gttgcggtgaggaacggtgaggaa

SEQ ID NO: 2280 - DNA, 24 bp, Artificial Sequence
  Description of Artificial Sequence: Synthetic oligonucleotide
  5' Phos
gttggtcggaggaagtcggaggaa

SEQ ID NO: 2281 - DNA, 24 bp, Artificial Sequence
  Description of Artificial Sequence: Synthetic oligonucleotide
  5' Phos
gttgccaggtcgaaccaggtcgaa

SEQ ID NO: 2282 - DNA, 24 bp, Artificial Sequence
  Description of Artificial Sequence: Synthetic oligonucleotide
  5' Phos
gttgtccacgcgaatccacgcgaa

SEQ ID NO: 2283 - DNA, 24 bp, Artificial Sequence
  Description of Artificial Sequence: Synthetic oligonucleotide
  5' Phos
gttgcgcttccgaacgcttccgaa

SEQ ID NO: 2284 - DNA, 24 bp, Artificial Sequence
  Description of Artificial Sequence: Synthetic oligonucleotide
  5' Phos
gttgcaatcgagaacaatcgagaa

SEQ ID NO: 2285 - DNA, 24 bp, Artificial Sequence
  Description of Artificial Sequence: Synthetic oligonucleotide
  5' Phos
gttgctagagagaactagagagaa

SEQ ID NO: 2286 - DNA, 24 bp, Artificial Sequence
  Description of Artificial Sequence: Synthetic oligonucleotide
  5' Phos
gttgcgcgcaagaacgcgcaagaa

SEQ ID NO: 2287 - DNA, 24 bp, Artificial Sequence
  Description of Artificial Sequence: Synthetic oligonucleotide
  5' Phos
gttgccgacctcaaccgacctcaa

SEQ ID NO: 2288 - DNA, 24 bp, Artificial Sequence
  Description of Artificial Sequence: Synthetic oligonucleotide
  5' Phos
gttggcgtgtgcaagcgtgtgcaa

SEQ ID NO: 2289 - DNA, 24 bp, Artificial Sequence
  Description of Artificial Sequence: Synthetic oligonucleotide
  5' Phos
gttgcagagcgcaacagagcgcaa

SEQ ID NO: 2290 - DNA, 24 bp, Artificial Sequence
  Description of Artificial Sequence: Synthetic oligonucleotide
  5' Phos
gttggctgcagcaagctgcagcaa

SEQ ID NO: 2291 - DNA, 24 bp, Artificial Sequence
  Description of Artificial Sequence: Synthetic oligonucleotide
  5' Phos
gttgcagacgccaacagacgccaa

SEQ ID NO: 2292 - DNA, 24 bp, Artificial Sequence
  Description of Artificial Sequence: Synthetic oligonucleotide
  5' Phos
gttggaaggaccaagaaggaccaa

SEQ ID NO: 2293 - DNA, 24 bp, Artificial Sequence
  Description of Artificial Sequence: Synthetic oligonucleotide
  5' Phos
gttgctctcgacaactctcgacaa

SEQ ID NO: 2294 - DNA, 24 bp, Artificial Sequence
  Description of Artificial Sequence: Synthetic oligonucleotide
  5' Phos
gttggtacagacaagtacagacaa

SEQ ID NO: 2295 - DNA, 24 bp, Artificial Sequence
  Description of Artificial Sequence: Synthetic oligonucleotide
  5' Phos
gttggagagaacaagagagaacaa

SEQ ID NO: 2296 - DNA, 24 bp, Artificial Sequence
  Description of Artificial Sequence: Synthetic oligonucleotide
  5' Phos
gttgaacgtgtgttaacgtgtgtt

SEQ ID NO: 2297 - DNA, 24 bp, Artificial Sequence
  Description of Artificial Sequence: Synthetic oligonucleotide
  5' Phos
gttgactcgatgttactcgatgtt

SEQ ID NO: 2298 - DNA, 24 bp, Artificial Sequence
  Description of Artificial Sequence: Synthetic oligonucleotide
  5' Phos
gttggtcctcggttgtcctcggtt

SEQ ID NO: 2299 - DNA, 24 bp, Artificial Sequence
  Description of Artificial Sequence: Synthetic oligonucleotide
  5' Phos
gttgctactaggttctactaggtt

SEQ ID NO: 2300 - DNA, 24 bp, Artificial Sequence
  Description of Artificial Sequence: Synthetic oligonucleotide
  5' Phos
gttgagtatgcgttagtatgcgtt

SEQ ID NO: 2301 - DNA, 24 bp, Artificial Sequence
  Description of Artificial Sequence: Synthetic oligonucleotide
  5' Phos
gttggaggttagttgaggttagtt

SEQ ID NO: 2302 - DNA, 24 bp, Artificial Sequence
  Description of Artificial Sequence: Synthetic oligonucleotide
  5' Phos
gttgctccttagttctccttagtt

SEQ ID NO: 2303 - DNA, 24 bp, Artificial Sequence
  Description of Artificial Sequence: Synthetic oligonucleotide
  5' Phos
gttgagaacgagttagaacgagtt

SEQ ID NO: 2304 - DNA, 24 bp, Artificial Sequence
  Description of Artificial Sequence: Synthetic oligonucleotide
  5' Phos
gttgagcggcagttagcggcagtt

SEQ ID NO: 2305 - DNA, 26 bp, Artificial Sequence
  Description of Artificial Sequence: Synthetic oligonucleotide
  5' Phos
  modified_base (16)..(16): biotinylated-T
cggatgtagataggatggacttagcg

SEQ ID NO: 2306 - DNA, 31 bp, Artificial Sequence
  Description of Artificial Sequence: Synthetic oligonucleotide
  5' Phos
  misc_feature (30)..(31): Phosphorothioate linkage
tctgcgctaagtccatcctatctacatccgt

SEQ ID NO: 2307 - DNA, 20 bp, Artificial Sequence
  Description of Artificial Sequence: Synthetic oligonucleotide
tctgcgctaagtccatccta

SEQ ID NO: 2308 - DNA, 24 bp, Artificial Sequence
  Description of Artificial Sequence: Synthetic oligonucleotide
  5' Phos
ttcggtaccagcatgtaccagcat

SEQ ID NO: 2309 - DNA, 24 bp, Artificial Sequence
  Description of Artificial Sequence: Synthetic oligonucleotide
  5' Phos
gtcaatgctggtacatgctggtac

SEQ ID NO: 2310 - DNA, 24 bp, Artificial Sequence
  Description of Artificial Sequence: Synthetic oligonucleotide
  5' Phos
ttcggtatacatccgtatacatcc

SEQ ID NO: 2311 - DNA, 24 bp, Artificial Sequence
  Description of Artificial Sequence: Synthetic oligonucleotide
  5' Phos
gtcaggatgtatacggatgtatac

SEQ ID NO: 2312 - DNA, 24 bp, Artificial Sequence
  Description of Artificial Sequence: Synthetic oligonucleotide
  5' Phos
ttcggtatcgctcagtatcgctca

SEQ ID NO: 2313 - DNA, 24 bp, Artificial Sequence
  Description of Artificial Sequence: Synthetic oligonucleotide
  5' Phos
gtcatgagcgatactgagcgatac

SEQ ID NO: 2314 - DNA, 24 bp, Artificial Sequence
  Description of Artificial Sequence: Synthetic oligonucleotide
  5' Phos
ttcggtccgatggagtccgatgga

SEQ ID NO: 2315 - DNA, 24 bp, Artificial Sequence
  Description of Artificial Sequence: Synthetic oligonucleotide
  5' Phos
gtcatccatcggactccatcggac

SEQ ID NO: 2316 - DNA, 24 bp, Artificial Sequence
  Description of Artificial Sequence: Synthetic oligonucleotide
  5' Phos
tgacgtgtggaattgtgtggaatt

SEQ ID NO: 2317 - DNA, 20 bp, Artificial Sequence
  Description of Artificial Sequence: Synthetic oligonucleotide
aattccacacaattccacac

SEQ ID NO: 2318 - DNA, 24 bp, Artificial Sequence
  Description of Artificial Sequence: Synthetic oligonucleotide
  5' Phos
tgacgtgtggcagagtgtggcaga

SEQ ID NO: 2319 - DNA, 20 bp, Artificial Sequence
  Description of Artificial Sequence: Synthetic oligonucleotide
tctgccacactctgccacac

SEQ ID NO: 2320 - DNA, 24 bp, Artificial Sequence
  Description of Artificial Sequence: Synthetic oligonucleotide
  5' Phos
tgacgttacggtgagttacggtga

SEQ ID NO: 2321 - DNA, 20 bp, Artificial Sequence
  Description of Artificial Sequence: Synthetic oligonucleotide
tcaccgtaactcaccgtaac

SEQ ID NO: 2322 - DNA, 24 bp, Artificial Sequence
  Description of Artificial Sequence: Synthetic oligonucleotide
  5' Phos
tgacgttcgtacatgttcgtacat

SEQ ID NO: 2323 - DNA, 20 bp, Artificial Sequence
  Description of Artificial Sequence: Synthetic oligonucleotide
atgtacgaacatgtacgaac

SEQ ID NO: 2324 - DNA, 30 bp, Artificial Sequence
  Description of Artificial Sequence: Synthetic oligonucleotide
ccatctcatccctgcgtgtctccgactcag

SEQ ID NO: 2325 - DNA, 27 bp, Artificial Sequence
  Description of Artificial Sequence: Synthetic oligonucleotide
ctgagactgccaaccgcgctccctccg

SEQ ID NO: 2326 - DNA, 27 bp, Artificial Sequence
  Description of Artificial Sequence: Synthetic oligonucleotide
ctgagtcggagacgcccgaccgttccg

SEQ ID NO: 2327 - DNA, 30 bp, Artificial Sequence
  Description of Artificial Sequence: Synthetic oligonucleotide
cctatcccctgtgtgccttggcagtctcag

SEQ ID NO: 2328 - DNA, 15 bp, Artificial Sequence
  Description of Artificial Sequence: Synthetic oligonucleotide
gcctccctcgcgcca

SEQ ID NO: 2329 - DNA, 15 bp, Artificial Sequence
  Description of Artificial Sequence: Synthetic oligonucleotide
gccttgccagcccgc

SEQ ID NO: 2330 - DNA, 19 bp, Artificial Sequence
  Description of Artificial Sequence: Synthetic oligonucleotide
ggtagagtagggacgcacc

SEQ ID NO: 2331 - DNA, 18 bp, Artificial Sequence
  Description of Artificial Sequence: Synthetic oligonucleotide
ggataggggacacacgga

SEQ ID NO: 2332 - DNA, 19 bp, Artificial Sequence
  Description of Artificial Sequence: Synthetic oligonucleotide
tagggacgcacagaggctg

SEQ ID NO: 2333 - DNA, 19 bp, Artificial Sequence
  Description of Artificial Sequence: Synthetic oligonucleotide
ggacacacggaaccgtcag

SEQ ID NO: 2334 - DNA, 27 bp, Artificial Sequence
  Description of Artificial Sequence: Synthetic oligonucleotide
cggaacggtcgggcgtctccgactcag

SEQ ID NO: 2335 - DNA, 29 bp, Artificial Sequence
  Description of Artificial Sequence: Synthetic oligonucleotide
ctgagactgccaaggcacacaggggtagg

SEQ ID NO: 2336 - DNA, 27 bp, Artificial Sequence
  Description of Artificial Sequence: Synthetic oligonucleotide
cggagggagcgcggttggcagtctcag

SEQ ID NO: 2337 - DNA, 30 bp, Artificial Sequence
  Description of Artificial Sequence: Synthetic oligonucleotide
ctgagtcggagacacgcagggatgagatgg

SEQ ID NO: 2338 - DNA, 27 bp, Artificial Sequence
  Description of Artificial Sequence: Synthetic oligonucleotide
cggaacggtcgggcgtctccgactcag

SEQ ID NO: 2339 - DNA, 30 bp, Artificial Sequence
  Description of Artificial Sequence: Synthetic oligonucleotide
ctgagactgccaaggcacacaggggatagg

SEQ ID NO: 2340 - DNA, 30 bp, Artificial Sequence
  Description of Artificial Sequence: Synthetic oligonucleotide
gactcagcctctgtgcgtccctactctacc

SEQ ID NO: 2341 - DNA, 254 bp, Artificial Sequence
  Description of Artificial Sequence: Synthetic polynucleotide
  modified_base (5)..(24): a, c, t, g, unknown or other
  modified_base (29)..(48): a, c, t, g, unknown or other
  modified_base (53)..(72): a, c, t, g, unknown or other
  modified_base (77)..(96): a, c, t, g, unknown or other
  misc_feature (127)..(128): Nucleotides at these positions are non-consecutive and are separated by a non-disclosed gDNA sequence
  modified_base (159)..(178): a, c, t, g, unknown or other
  modified_base (183)..(202): a, c, t, g, unknown or other
  modified_base (207)..(226): a, c, t, g, unknown or other
  modified_base (231)..(250): a, c, t, g, unknown or other
gttgnnnnnnnnnnnnnnnnnnnngggannnnnnnnnnnnnnnnnnnngtcannnnnnnnnnnnnnnnnnnncgaannnnnnnnnnnnnnnnnnnntctgcgctaagtccatcctatctacatccgtacggatgtagataggatggacttagcgcagannnnnnnnnnnnnnnnnnnnttcgnnnnnnnnnnnnnnnnnnnntgacnnnnnnnnnnnnnnnnnnnntcccnnnnnnnnnnnnnnnnnnnncaac

SEQ ID NO: 2342 - DNA, 24 bp, Artificial Sequence
  Description of Artificial Sequence: Synthetic oligonucleotide
  modified_base (5)..(24): a, c, t, g, unknown or other
gttgnnnnnnnnnnnnnnnnnnnn

SEQ ID NO: 2343 - DNA, 24 bp, Artificial Sequence
  Description of Artificial Sequence: Synthetic oligonucleotide
  modified_base (5)..(24): a, c, t, g, unknown or other
gggannnnnnnnnnnnnnnnnnnn

SEQ ID NO: 2344 - DNA, 24 bp, Artificial Sequence
  Description of Artificial Sequence: Synthetic oligonucleotide
  modified_base (5)..(24): a, c, t, g, unknown or other
gtcannnnnnnnnnnnnnnnnnnn

SEQ ID NO: 2345 - DNA, 24 bp, Artificial Sequence
  Description of Artificial Sequence: Synthetic oligonucleotide
  modified_base (5)..(24): a, c, t, g, unknown or other
cgaannnnnnnnnnnnnnnnnnnn

SEQ ID NO: 2346 - DNA, 31 bp, Artificial Sequence
  Description of Artificial Sequence: Synthetic oligonucleotide
  modified_base (5)..(30): a, c, t, g, unknown or other
tctgnnnnnnnnnnnnnnnnnnnnnnnnnnt

SEQ ID NO: 2347 - DNA, 24 bp, Artificial Sequence
  Description of Artificial Sequence: Synthetic oligonucleotide
  modified_base (5)..(24): a, c, t, g, unknown or other
tcccnnnnnnnnnnnnnnnnnnnn

SEQ ID NO: 2348 - DNA, 24 bp, Artificial Sequence
  Description of Artificial Sequence: Synthetic oligonucleotide
  modified_base (5)..(24): a, c, t, g, unknown or other
tgacnnnnnnnnnnnnnnnnnnnn

SEQ ID NO: 2349 - DNA, 24 bp, Artificial Sequence
  Description of Artificial Sequence: Synthetic oligonucleotide
  modified_base (5)..(24): a, c, t, g, unknown or other
ttcgnnnnnnnnnnnnnnnnnnnn

SEQ ID NO: 2350 - DNA, 24 bp, Artificial Sequence
  Description of Artificial Sequence: Synthetic oligonucleotide
  modified_base (5)..(24): a, c, t, g, unknown or other
cagannnnnnnnnnnnnnnnnnnn

SEQ ID NO: 2351 - DNA, 66 bp, Artificial Sequence
  Description of Artificial Sequence: Synthetic oligonucleotide
cgattgaggccggtaatacgactcactatagggacactctttccctacacgacgctcttccgatct

SEQ ID NO: 2352 - DNA, 70 bp, Artificial Sequence
  Description of Artificial Sequence: Synthetic oligonucleotide
caacagatcggaagagcgtcgtgtagggaaagagtgtccctatagtgagtcgtattaccggcctcaatcg

SEQ ID NO: 2353 - DNA, 200 bp, Artificial Sequence
  Description of Artificial Sequence: Synthetic polynucleotide
  modified_base (5)..(24): a, c, t, g, unknown or other
  modified_base (29)..(48): a, c, t, g, unknown or other
  modified_base (53)..(72): a, c, t, g, unknown or other
  modified_base (77)..(96): a, c, t, g, unknown or other
  misc_feature (100)..(101): Nucleotides at these positions are non-consecutive and are separated by a non-disclosed capped gDNA sequence
  modified_base (105)..(124): a, c, t, g, unknown or other
  modified_base (129)..(149): a, c, t, g, unknown or other
  modified_base (153)..(172): a, c, t, g, unknown or other
  modified_base (175)..(196): a, c, t, g, unknown or other
caacnnnnnnnnnnnnnnnnnnnngggannnnnnnnnnnnnnnnnnnngtcannnnnnnnnnnnnnnnnnnncgaannnnnnnnnnnnnnnnnnnntctgcagannnnnnnnnnnnnnnnnnnnttcgnnnnnnnnnnnnnnnnnnnntgacnnnnnnnnnnnnnnnnnnnntcccnnnnnnnnnnnnnnnnnnnncaac

SEQ ID NO: 2354 - DNA, 40 bp, Artificial Sequence
  Description of Artificial Sequence: Synthetic oligonucleotide
  modified_base (35)..(40): a, c, t, g, unknown or other
gtgactggagttcagacgtgtgctcttccgatctnnnnnn

SEQ ID NO: 2355 - DNA, 58 bp, Artificial Sequence
  Description of Artificial Sequence: Synthetic oligonucleotide
aatgatacggcgaccaccgagatctacactctttccctacacgacgctcttccgatct

SEQ ID NO: 2356 - DNA, 66 bp, Artificial Sequence
  Description of Artificial Sequence: Synthetic oligonucleotide
caagcagaagacggcatacgagatcctggtaggtgactggagttcagacgtgtgctcttccgatct

SEQ ID NO: 2357 - DNA, 33 bp, Artificial Sequence
  Description of Artificial Sequence: Synthetic oligonucleotide
acactctttccctacacgacgctcttccgatct

SEQ ID NO: 2358 - DNA, 67 bp, Artificial Sequence
  Description of Artificial Sequence: Synthetic oligonucleotide
  misc_feature (34)..(35): Nucleotides at these positions are non-consecutive and are separated by a non-disclosed sequence
gtgactggagttcagacgtgtgctcttccgatctagatcggaagagcgtcgtgtagggaaagagtgt

SEQ ID NO: 2359 - DNA, 92 bp, Artificial Sequence
  Description of Artificial Sequence: Synthetic oligonucleotide
  misc_feature (58)..(59): Nucleotides at these positions are non-consecutive and are separated by a non-disclosed sequence
aatgatacggcgaccaccgagatctacactctttccctacacgacgctcttccgatctagatcggaagagcacacgtctgaactccagtcac

SEQ ID NO: 2360 - DNA, 124 bp, Artificial Sequence
  Description of Artificial Sequence: Synthetic polynucleotide
  misc_feature (58)..(59): Nucleotides at these positions are non-consecutive and are separated by a non-disclosed sequence
aatgatacggcgaccaccgagatctacactctttccctacacgacgctcttccgatctagatcggaagagcacacgtctgaactccagtcacctaccaggatctcgtatgccgtcttctgcttg

SEQ ID NO: 2361 - DNA, 200 bp, Artificial Sequence
  Description of Artificial Sequence: Synthetic polynucleotide
  modified_base (5)..(24): a, c, t, g, unknown or other
  modified_base (29)..(48): a, c, t, g, unknown or other
  modified_base (53)..(72): a, c, t, g, unknown or other
  modified_base (77)..(96): a, c, t, g, unknown or other
  misc_feature (100)..(101): Nucleotides at these positions are non-consecutive and are separated by a non-disclosed capped gDNA sequence
  modified_base (105)..(124): a, c, t, g, unknown or other
  modified_base (129)..(149): a, c, t, g, unknown or other
  modified_base (153)..(172): a, c, t, g, unknown or other
  modified_base (175)..(196): a, c, t, g, unknown or other
gttgnnnnnnnnnnnnnnnnnnnngggannnnnnnnnnnnnnnnnnnngtcannnnnnnnnnnnnnnnnnnncgaannnnnnnnnnnnnnnnnnnntctgcagannnnnnnnnnnnnnnnnnnnttcgnnnnnnnnnnnnnnnnnnnntgacnnnnnnnnnnnnnnnnnnnntcccnnnnnnnnnnnnnnnnnnnncaac

What is claimed is:

1. A method for labeling mRNAs with a unique label comprising the steps of:
   (a) providing a pool of mRNAs;
   (b) separating the pool of mRNAs into sub-pools of mRNAs;
   (c) end-labeling each of said mRNAs with a detectable oligonucleotide tag, each of said oligonucleotide tags optionally comprising a cohesive overhang of x base pairs in length, such that the mRNAs in each sub-pool are identically end-labeled to each other but differently end-labeled from the mRNAs in other sub-pools; and
   (d) combining the sub-pools of end-labeled mRNAs from step (c) to create a new pool of mRNAs:
   (e) repeating steps (b)-(d) two or more times to sequentially end-label the mRNAs with a random combination of oligonucleotide tags; and
   (f) amplifying the end-labeled mRNAs formed in step (e) wherein the amplifying comprises:
   (i) attaching an adapter comprising a first sequencing primer, and a capture moiety to the end-labeled mRNAs formed in step (e).

2. The method of claim 1, wherein the amplifying further comprises the steps of:
   (ii) performing a reverse transcription using a primer comprising a random nucleotide sequence of a given length flanked by a second sequencing primer.

3. The method according to claim 1, wherein said method is performed in a multi-well plate.

4. The method according to claim 1, wherein said method is performed with a robotic liquid-handler.

5. The method of claim 1, wherein the capture moiety is biotin.

6. The method of claim 1, wherein the capture moiety is a microbead.

* * * * *